US006420526B1

(12) United States Patent
Ruben et al.

(10) Patent No.: US 6,420,526 B1
(45) Date of Patent: Jul. 16, 2002

(54) 186 HUMAN SECRETED PROTEINS

(75) Inventors: Steven M. Ruben, Olney; Craig A. Rosen, Laytonsville, both of MD (US); Carrie L. Fischer, Burke; Daniel P. Soppet, Centreville, both of VA (US); Kenneth C. Carter, North Potomac, MD (US); Daniel R. Bednarik, Columbia, MD (US); Gregory A. Endress, Potomac, MD (US); Guo-Liang Yu, Berkeley, CA (US); Jian Ni, Rockville, MD (US); Ping Feng, Gaithersburg, MD (US); Paul E. Young, Gaithersburg, MD (US); John M. Greene, Gaithersburg, MD (US); Ann M. Ferrie, Tewksbury, MA (US); Roxanne Duan, Bethesda, MD (US); Jing-Shan Hu, Sunnyvale, CA (US); Kimberly A. Florence, Rockville, MD (US); Henrik S. Olsen; Reinhard Ebner, both of Gaithersburg, MD (US); Laurie A. Brewer, St. Paul, MN (US); Paul A. Moore, Germantown, MD (US); Yanggu Shi, Gaithersburg, MD (US); David W. Lafleur, Washington, DC (US); Yi Li, Sunnyvale, CA (US); Zhizhen Zeng, Lansdale, PA (US); Hla Kyaw, Frederick, MD (US)

(73) Assignee: Human Genome Sciences, Inc., Rockville, MD (US)

( * ) Notice: Subject to any disclaimer, the term of this patent is extended or adjusted under 35 U.S.C. 154(b) by 0 days.

(21) Appl. No.: 09/149,476

(22) Filed: Sep. 8, 1998

Related U.S. Application Data

(63) Continuation-in-part of application No. PCT/US98/04493, filed on Mar. 6, 1998.
(60) Provisional application No. 60/040,162, filed on Mar. 7, 1997, provisional application No. 60/040,333, filed on Mar. 7, 1997, provisional application No. 60/038,621, filed on (List continued on next page.)

(51) Int. Cl.[7] .............................. C12Q 1/68; C07K 1/00; C07H 21/02
(52) U.S. Cl. ........................... 530/350; 435/6; 536/23.1
(58) Field of Search .................... 435/6, 183; 536/23.1; 530/350

(56) References Cited

U.S. PATENT DOCUMENTS 5,536,637 A   7/1996   Jacobs

FOREIGN PATENT DOCUMENTS

| EP | 0 679 716 | 11/1995 |
| WO | WO 90 14432 | 11/1990 |
| WO | WO 96 17925 | 6/1996 |
| WO | WO 97 04097 | 2/1997 |
| WO | WO 97 07198 | 2/1997 |
| WO | WO 98/39448 | 9/1998 |

OTHER PUBLICATIONS

Nathan et al., "TREM–1: A New Regulator of Innate Immunity in Sepsis Syndrome", Nature Medicine, vol. 7, No. 5, pp. 530–532 (May, 2001).
Bouchon et al., "TREM–1 Amplifies Inflammation and is a Crucial Mediator of Septic Shock", Nature, vol. 410, pp. 1103–1107 (Apr. 26, 2001).
Genbank Accession No. AAF71694 (May 24, 2000).
Bouchon et al., "Cutting edge: inflammatory responses . . . ", J. Immunol., 164(10):4991–4995 (May 15, 2000).
Geneseq Accession No. Y87334 (Jan. 6, 2000).
Geneseq Accession No. Z98219 (Jan. 6, 2000).
Genbank Accession No. H04128 (Jun. 20, 1995).
Genbank Accession No. N39235 (Jan. 19, 1996).
Genbank Accession No. H16400 (Jun. 27, 1995).
Jacobs et al., "A novel method for isolating eukaryotic cDNA clones . . . ", J. of Cell. Biochem. Suppl., abstract No. C1–207 (1995).
Suzuki et al., "An Introduction to Genetic Analysis", Third Edition, W.H. Freeman and Company, New York, NY (1986).
Geneseq Accession No. Y02365 (04/15/99)
George et al., "Current Methods in Sequence Comparison and Analysis", Macromolecular Sequencing and Synthesis, Selected Methods and Applications, D.H. Schlesinger (ed.) Alan R. Liss, Inc., New York, NY, pp. 127–149 (1988).
Barton et al., "Protein sequence alignment and database scanning", Protein Structure Prediction, A Practical Approach, IRL Press at Oxford University Press, Oxford, UK, pp. 31–63 (1996).
Geneseq Accession No. Y02365 (Apr. 15, 1999).
Geneseq Accession No. Y11659 (Feb. 11, 1999).
Geneseq Accession No. G00571 (Sep. 6, 2000).
Geneseq Accession No. X35709 (Apr. 15, 1999).
Geneseq Accession No. X35708 (Apr. 15, 1999).
Geneseq Accession No. X40377 (Feb. 11, 1999).
Geneseq Accession No. C00577 (Sep. 6, 2000).
Genbank Accession No. AA101983 (May 11, 1997).
Genbank Accession No. AA494171 (Aug. 19, 1997).
Genbank Accession No. AA099288 (May 11, 1997).
Genbank Accession No. D78812 (Feb. 9, 1996).

*Primary Examiner*—John S. Brusca
*Assistant Examiner*—Young Kim
(74) *Attorney, Agent, or Firm*—Human Genome Sciences, Inc

(57) ABSTRACT

The present invention relates to novel human secreted proteins and isolated nucleic acids containing the coding regions of the genes encoding such proteins. Also provided are vectors, host cells, antibodies, and recombinant methods for producing human secreted proteins. The invention further relates to diagnostic and therapeutic methods useful for diagnosing and treating disorders related to these novel human secreted proteins.

58 Claims, No Drawings

Related U.S. Application Data

Mar. 7, 1997, provisional application No. 60/040,626, filed on Mar. 7, 1997, provisional application No. 60/040,334, filed on Mar. 7, 1997, provisional application No. 60/040,336, filed on Mar. 7, 1997, provisional application No. 60/040,163, filed on Mar. 7, 1997, provisional application No. 60/047,600, filed on May 23, 1997, provisional application No. 60/047,615, filed on May 23, 1997, provisional application No. 60/047,597, filed on May 23, 1997, provisional application No. 60/047,502, filed on May 23, 1997, provisional application No. 60/047,633, filed on May 23, 1997, provisional application No. 60/047,583, filed on May 23, 1997, provisional application No. 60/047,617, filed on May 23, 1997, provisional application No. 60/047,618, filed on May 23, 1997, provisional application No. 60/047,503, filed on May 23, 1997, provisional application No. 60/047,592, filed on May 23, 1997, provisional application No. 60/047,581, filed on May 23, 1997, provisional application No. 60/047,584, filed on May 23, 1997, provisional application No. 60/047,500, filed on May 23, 1997, provisional application No. 60/047,587, filed on May 23, 1997, provisional application No. 60/047,492, filed on May 23, 1997, provisional application No. 60/047,598, filed on May 23, 1997, provisional application No. 60/047,613, filed on May 23, 1997, provisional application No. 60/047,582, filed on May 23, 1997, provisional application No. 60/047,596, filed on May 23, 1997, provisional application No. 60/047,612, filed on May 23, 1997, provisional application No. 60/047,632, filed on May 23, 1997, provisional application No. 60/047,601, filed on May 23, 1997, provisional application No. 60/043,580, filed on Apr. 11, 1997, provisional application No. 60/043,568, filed on Apr. 11, 1997, provisional application No. 60/043,314, filed on Apr. 11, 1997, provisional application No. 60/043,569, filed on Apr. 11, 1997, provisional application No. 60/043,311, filed on Apr. 11, 1997, provisional application No. 60/043,671, filed on Apr. 11, 1997, provisional application No. 60/043,674, filed on Apr. 11, 1997, provisional application No. 60/043,669, filed on Apr. 11, 1997, provisional application No. 60/043,312, filed on Apr. 11, 1997, provisional application No. 60/043,313, filed on Apr. 11, 1997, provisional application No. 60/043,672, filed on Apr. 11, 1997, provisional application No. 60/043,315, filed on Apr. 11, 1997, provisional application No. 60/048,974, filed on Jun. 6, 1997, provisional application No. 60/056,886, filed on Aug. 22, 1997, provisional application No. 60/056,877, filed on Aug. 22, 1997, provisional application No. 60/056,889, filed on Aug. 22, 1997, provisional application No. 60/056,893, filed on Aug. 22, 1997, provisional application No. 60/056,630, filed on Aug. 22, 1997, provisional application No. 60/056,878, filed on Aug. 22, 1997, provisional application No. 60/056,662, filed on Aug. 22, 1997, provisional application No. 60/056,872, filed on Aug. 22, 1997, provisional application No. 60/056,882, filed on Aug. 22, 1997, provisional application No. 60/056,637, filed on Aug. 22, 1997, provisional application No. 60/056,903, filed on Aug. 22, 1997, provisional application No. 60/056,888, filed on Aug. 22, 1997, provisional application No. 60/056,879, filed on Aug. 22, 1997, provisional application No. 60/056,880, filed on Aug. 22, 1997, provisional application No. 60/056,894, filed on Aug. 22, 1997, provisional application No. 60/056,911, filed on Aug. 22, 1997, provisional application No. 60/056,636, filed on Aug. 22, 1997, provisional application No. 60/056,874, filed on Aug. 22, 1997, provisional application No. 60/056,910, filed on Aug. 22, 1997, provisional application No. 60/056,864, filed on Aug. 22, 1997, provisional application No. 60/056,631, filed on Aug. 22, 1997, provisional application No. 60/056,845, filed on Aug. 22, 1997, provisional application No. 60/056,892, filed on Aug. 22, 1997, provisional application No. 60/057,761, filed on Aug. 22, 1997, provisional application No. 60/047,595, filed on May 23, 1997, provisional application No. 60/047,599, filed on May 23, 1997, provisional application No. 60/047,588, filed on May 23, 1997, provisional application No. 60/047,585, filed on May 23, 1997, provisional application No. 60/047,586, filed on May 23, 1997, provisional application No. 60/047,590, filed on May 23, 1997, provisional application No. 60/047,594, filed on May 23, 1997, provisional application No. 60/047,589, filed on May 23, 1997, provisional application No. 60/047,593, filed on May 23, 1997, provisional application No. 60/047,614, filed on May 23, 1997, provisional application No. 60/043,578, filed on Apr. 11, 1997, provisional application No. 60/043,576, filed on Apr. 11, 1997, provisional application No. 60/047,501, filed on May 23, 1997, provisional application No. 60/043,670, filed on Apr. 11, 1997, provisional application No. 60/056,632, filed on Aug. 22, 1997, provisional application No. 60/056,664, filed on Aug. 22, 1997, provisional application No. 60/056,876, filed on Aug. 22, 1997, provisional application No. 60/056,881, filed on Aug. 22, 1997, provisional application No. 60/056,909, filed on Aug. 22, 1997, provisional application No. 60/056,875, filed on Aug. 22, 1997, provisional application No. 60/056,862, filed on Aug. 22, 1997, provisional application No. 60/056,887, filed on Aug. 22, 1997, provisional application No. 60/056,908, filed on Aug. 22, 1997, provisional application No. 60/048,964, filed on Jun. 6, 1997, provisional application No. 60/057,650, filed on Sep. 5, 1997, provisional application No. 60/056,884, filed on Aug. 22, 1997, provisional application No. 60/057,669, filed on Sep. 5, 1997, provisional application No. 60/049,610, filed on Jun. 13, 1997, provisional application No. 60/061,060, filed on Oct. 2, 1997, provisional application No. 60/051,926, filed on Jul. 8, 1997, provisional application No. 60/052,874, filed on Jul. 16, 1997, provisional application No. 60/058,785, filed on Sep. 12, 1997, provisional application No. 60/055,724, filed on Aug. 18, 1997, and provisional application No. 60/040,161, filed on Mar. 7, 1997.

186 HUMAN SECRETED PROTEINS

This application is a continuation-in-part of copending U.S. patent application Ser. No: PCT/US98/04493, filed Mar. 6, 1998, which is hereby incorporated by reference, which claims benefit under 35 U.S.C. §119(e) based on U.S. Provisional Applications:

|  | Filing Date: | Applications: |
|---|---|---|
| 1. | 07-Mar-1997 | 60/040,162 |
| 2. | 07-Mar-1997 | 60/040,333 |
| 3. | 07-Mar-1997 | 60/038,621 |
| 4. | 07-Mar-1997 | 60/040,626 |
| 5. | 07-Mar-1997 | 60/040,334 |
| 6. | 07-Mar-1997 | 60/040,336 |
| 7. | 07-Mar-1997 | 60/040,163 |
| 8. | 23-May-1997 | 60/047,600 |
| 9. | 23-May-1997 | 60/047,615 |
| 10. | 23-May-1997 | 60/047,597 |
| 11. | 23-May-1997 | 60/047,502 |
| 12. | 23-May-1997 | 60/047,633 |
| 13. | 23-May-1997 | 60/047,583 |
| 14. | 23-May-1997 | 60/047,617 |
| 15. | 23-May-1997 | 60/047,618 |
| 16. | 23-May-1997 | 60/047,503 |
| 17. | 23-May-1997 | 60/047,592 |
| 18 | 23-May-1997 | 60/047,581 |
| 19. | 23-May-1997 | 60/047,584 |
| 20. | 23-May-1997 | 60/047,500 |
| 21. | 23-May-1997 | 60/047,587 |
| 22. | 23-May-1997 | 60/047,492 |
| 23. | 23-May-1997 | 60/047,598 |
| 24. | 23-May-1997 | 60/047,613 |
| 25. | 23-May-1997 | 60/047,582 |
| 26. | 23-May-1997 | 60/047,596 |
| 27. | 23-May-1997 | 60/047,612 |
| 28. | 23-May-1997 | 60/047,632 |
| 29. | 23-May-1997 | 60/047,601 |
| 30. | 11-Apr-1997 | 60/043,580 |
| 31. | 11-Apr-1997 | 60/043,568 |
| 32. | 11-Apr-1997 | 60/043,314 |
| 33. | 11-Apr-1997 | 60/043,569 |
| 34. | 11-Apr-1997 | 60/043,311 |
| 35. | 11-Apr-1997 | 60/043,671 |
| 36. | 11-Apr-1997 | 60/043,674 |
| 37. | 11-Apr-1997 | 60/043,669 |
| 38. | 11-Apr-1997 | 60/043,312 |
| 39. | 11-Apr-1997 | 60/043,313 |
| 40. | 11-Apr-1997 | 60/043,672 |
| 41. | 11-Apr-1997 | 60/043,315 |
| 42. | 06-Jun-1997 | 60/048,974 |
| 43. | 22-Aug-1997 | 60/056,886 |
| 44. | 22-Aug-1997 | 60/056,877 |
| 45. | 22-Aug-1997 | 60/056,889 |
| 46. | 22-Aug-1997 | 60/056,893 |
| 47. | 22-Aug-1997 | 60/056,630 |
| 48. | 22-Aug-1997 | 60/056,878 |
| 49. | 22-Aug-1997 | 60/056,662 |
| 50. | 22-Aug-1997 | 60/056,872 |
| 51. | 22-Aug-1997 | 60/056,882 |
| 52. | 22-Aug-1997 | 60/056,637 |
| 53. | 22-Aug-1997 | 60/056,903 |
| 54. | 22-Aug-1997 | 60/056,888 |
| 55. | 22-Aug-1997 | 60/056,879 |
| 56. | 22-Aug-1997 | 60/056,880 |
| 57. | 22-Aug-1997 | 60/056,894 |
| 58. | 22-Aug-1997 | 60/056,911 |
| 59. | 22-Aug-1997 | 60/056,636 |
| 60. | 22-Aug-1997 | 60/056,874 |
| 61. | 22-Aug-1997 | 60/056,910 |
| 62. | 22-Aug-1997 | 60/056,864 |
| 63. | 22-Aug-1997 | 60/056,631 |
| 64. | 22-Aug-1997 | 60/056,845 |
| 65. | 22-Aug-1997 | 60/056,892 |
| 66. | 22-Aug-1997 | 60/056,761 |
| 67. | 23-May-1997 | 60/047,595 |
| 68. | 23-May-1997 | 60/047,599 |

-continued

|  | Filing Date: | Applications: |
|---|---|---|
| 69. | 23-May-1997 | 60/047,588 |
| 70. | 23-May-1997 | 60/047,585 |
| 71. | 23-May-1997 | 60/047,586 |
| 72. | 23-May-1997 | 60/047,590 |
| 73. | 23-May-1997 | 60/047,594 |
| 74. | 23-May-1997 | 60/047,589 |
| 75. | 23-May-1997 | 60/047,593 |
| 76. | 23-May-1997 | 60/047,614 |
| 77. | 11-Apr-1997 | 60/043,578 |
| 78. | 11-Apr-1997 | 60/043,576 |
| 79. | 23-May-1997 | 60/047,501 |
| 80. | 11-Apr-1997 | 60/043,670 |
| 81 | 22-Aug-1997 | 60/056,632 |
| 82 | 22-Aug-1997 | 60/056,664 |
| 83 | 22-Aug-1997 | 60/056,876 |
| 84 | 22-Aug-1997 | 60/056,881 |
| 85 | 22-Aug-1997 | 60/056,909 |
| 86 | 22-Aug-1997 | 60/056,875 |
| 87 | 22-Aug-1997 | 60/056,862 |
| 88 | 22-Aug-1997 | 60/056,887 |
| 89 | 22-Aug-1997 | 60/056,908 |
| 90. | 06-Jun-1997 | 60/048,964 |
| 91. | 05-Sep-1997 | 60/057,650 |
| 92 | 22-Aug-1997 | 60/056,884 |
| 93 | 05-Sep-1997 | 60/057,669 |
| 94 | 13-Jun-1997 | 60/049,610 |
| 95 | 02-Oct-1997 | 60/061,060 |
| 96 | 08-Jul-1997 | 60/051,926 |
| 97 | 16-Jul-1997 | 60/052,874 |
| 98 | 12-Sep-1997 | 60/058,785 |
| 99 | 18 Aug-1997 | 60/055,724 |
| 100 | 07-Mar-1997 | 60/040,161 |

FIELD OF THE INVENTION

This invention relates to newly identified polynucleotides and the polypeptides encoded by these polynucleotides, uses of such polynucleotides and polypeptides, and their production.

BACKGROUND OF THE INVENTION

Unlike bacterium, which exist as a single compartment surrounded by a membrane, human cells and other eucaryotes are subdivided by membranes into many functionally distinct compartments. Each membrane-bounded compartment, or organelle, contains different proteins essential for the function of the organelle. The cell uses "sorting signals," which are amino acid motifs located within the protein, to target proteins to particular cellular organelles.

One type of sorting signal, called a signal sequence, a signal peptide, or a leader sequence, directs a class of proteins to an organelle called the endoplasmic reticulum (ER). The ER separates the membrane-bounded proteins from all other types of proteins. Once localized to the ER, both groups of proteins can be further directed to another organelle called the Golgi apparatus. Here, the Golgi distributes the proteins to vesicles, including secretory vesicles, the cell membrane, lysosomes, and the other organelles.

Proteins targeted to the ER by a signal sequence can be released into the extracellular space as a secreted protein. For example, vesicles containing secreted proteins can fuse with the cell membrane and release their contents into the extracellular space—a process called exocytosis. Exocytosis can occur constitutively or after receipt of a triggering signal. In the latter case, the proteins are stored in secretory vesicles (or secretory granules) until exocytosis is triggered. Similarly, proteins residing on the cell membrane can also be secreted into the extracellular space by proteolytic cleavage of a "linker" holding the protein to the membrane.

Despite the great progress made in recent years, only a small number of genes encoding human secreted proteins have been identified. These secreted proteins include the commercially valuable human insulin, interferon, Factor VIII, human growth hormone, tissue plasminogen activator, and erythropoeitin. Thus, in light of the pervasive role of secreted proteins in human physiology, a need exists for identifying and characterizing novel human secreted proteins and the genes that encode them. This knowledge will allow one to detect, to treat, and to prevent medical disorders by using secreted proteins or the genes that encode them.

SUMMARY OF THE INVENTION

The present invention relates to novel polynucleotides and the encoded polypeptides. Moreover, the present invention relates to vectors, host cells, antibodies, and recombinant methods for producing the polypeptides and polynucleotides. Also provided are diagnostic methods for detecting disorders related to the polypeptides, and therapeutic methods for treating such disorders. The invention further relates to screening methods for identifying binding partners of the polypeptides.

DETAILED DESCRIPTION

Definitions

The following definitions are provided to facilitate understanding of certain terms used throughout this specification.

In the present invention, "isolated" refers to material removed from its original environment (e.g. the natural environment if it is naturally occurring), and thus is altered "by the hand of man" from its natural state. For example, an isolated polynucleotide could be part of a vector or a composition of matter, or could be contained within a cell, and still be "isolated" because that vector, composition of matter, or particular cell is not the original environment of the polynucleotide.

In the present invention, a "secreted" protein refers to those proteins capable of being directed to the ER, secretory vesicles, or the extracellular space as a result of a signal sequence, as well as those proteins released into the extracellular space without necessarily containing a signal sequence. If the secreted protein is released into the extracellular space, the secreted protein can undergo extracellular processing to produce a "mature" protein. Release into the extracellular space can occur by many mechanisms, including exocytosis and proteolytic cleavage.

As used herein, a "polynucleotide" refers to a molecule having a nucleic acid sequence contained in SEQ ID NO:X or the cDNA contained within the clone deposited with the ATCC. For example, the polynucleotide can contain the nucleotide sequence of the full length cDNA sequence, including the 5' and 3' untranslated sequences, the coding region, with or without the signal sequence, the secreted protein coding region, as well as fragments, epitopes, domains, and variants of the nucleic acid sequence. Moreover, as used herein, a "polypeptide" refers to a molecule having the translated amino acid sequence generated from the polynucleotide as broadly defined.

In the present invention, the full length sequence identified as SEQ ID NO:X was often generated by overlapping sequences contained in multiple clones (contig analysis). A representative clone containing all or most of the sequence for SEQ ID NO:X was deposited with the American Type Culture Collection ("ATCC"). As shown in Table 1, each clone is identified by a cDNA Clone ID (Identifier) and the ATCC Deposit Number. The ATCC is located at 10801 University Boulevard, Manassas, Va. 20110-2209, USA.

The ATCC deposit was made pursuant to the terms of the Budapest Treaty on the international recognition of the deposit of microorganisms for purposes of patent procedure.

A "polynucleotide" of the present invention also includes those polynucleotides capable of hybridizing, under stringent hybridization conditions, to sequences contained in SEQ ID NO:X, the complement thereof, or the cDNA within the clone deposited with the ATCC. "Stringent hybridization conditions" refers to an overnight incubation at 42° C. in a solution comprising 50% formamide, 5×SSC (750 mM NaCl, 75 mM sodium citrate), 50 mM sodium phosphate (pH 7.6), 5×Denhardt's solution, 10% dextran sulfate, and 20 $\mu$g/ml denatured, sheared salmon sperm DNA, followed by washing the filters in 0.1×SSC at about 65° C.

Also contemplated are nucleic acid molecules that hybridize to the polynucleotides of the present invention at lower stringency hybridization conditions. Changes in the stringency of hybridization and signal detection are primarily accomplished through the manipulation of formamide concentration (lower percentages of formamide result in lowered stringency); salt conditions, or temperature. For example, lower stringency conditions include an overnight incubation at 37° C. in a solution comprising 6×SSPE (20×SSPE=3M NaCl; 0.2M $NaH_2PO_4$; 0.02M EDTA, pH 7.4), 0.5% SDS, 30% formamide, 100 ug/ml salmon sperm blocking DNA; followed by washes at 50° C. with lXSSPE, 0.1% SDS. In addition, to achieve even lower stringency, washes performed following stringent hybridization can be done at higher salt concentrations (e.g. 5×SSC).

Note that variations in the above conditions may be accomplished through the inclusion and/or substitution of alternate blocking reagents used to suppress background in hybridization experiments. Typical blocking reagents include Denhardt's reagent, BLOTTO, heparin, denatured salmon sperm DNA, and commercially available proprietary formulations. The inclusion of specific blocking reagents may require modification of the hybridization conditions described above, due to problems with compatibility.

Of course, a polynucleotide which hybridizes only to polyA+sequences (such as any 3' terminal polyA+tract of a cDNA shown in the sequence listing), or to a complementary stretch of T (or U) residues, would not be included in the definition of "polynucleotide," since such a polynucleotide would hybridize to any nucleic acid molecule containing a poly (A) stretch or the complement thereof (e.g. practically any double-stranded cDNA clone).

The polynucleotide of the present invention can be composed of any polyribonucleotide or polydeoxribonucleotide, which may be unmodified RNA or DNA or modified RNA or DNA. For example, polynucleotides can be composed of single- and double-stranded DNA, DNA that is a mixture of single- and double-stranded regions, single- and double-stranded RNA, and RNA that is mixture of single- and double-stranded regions, hybrid molecules comprising DNA and RNA that may be single-stranded or, more typically, double-stranded or a mixture of single- and double-stranded regions. In addition, the polynucleotide can be composed of triple-stranded regions comprising RNA or DNA or both RNA and DNA. A polynucleotide may also contain one or more modified bases or DNA or RNA backbones modified for stability or for other reasons. "Modified" bases include, for example, tritylated bases and unusual bases such as inosine. A variety of modifications can be made to DNA and RNA; thus, "polynucleotide" embraces chemically, enzymatically, or metabolically modified forms.

The polypeptide of the present invention can be composed of amino acids joined to each other by peptide bonds or modified peptide bonds, i.e., peptide isosteres, and may contain amino acids other than the 20 gene-encoded amino acids. The polypeptides may be modified by either natural processes, such as posttranslational processing, or by chemical modification techniques which are well known in the art. Such modifications are well described in basic texts and in more detailed monographs, as well as in a voluminous research literature. Modifications can occur anywhere in a polypeptide, including the peptide backbone, the amino acid side-chains and the amino or carboxyl termini. It will be appreciated that the same type of modification may be present in the same or varying degrees at several sites in a given polypeptide. Also, a given polypeptide may contain many types of modifications. Polypeptides may be branched, for example, as a result of ubiquitination, and they may be cyclic, with or without branching. Cyclic, branched, and branched cyclic polypeptides may result from posttranslation natural processes or may be made by synthetic methods. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristoylation, oxidation, pegylation, proteolytic processing, phosphorylation, prenylation, racemization, selenoylation, sulfation, transfer-RNA mediated addition of amino acids to proteins such as arginylation, and ubiquitination. (See, for instance, PROTEINS—STRUCTURE AND MOLECULAR PROPERTIES, 2nd Ed., T. E. Creighton, W. H. Freeman and Company, New York (1993); POSTTRANSLATIONAL COVALENT MODIFICATION OF PROTEINS, B. C. Johnson, Ed., Academic Press, New York, pgs. 1–12 (1983); Seifter et al., Meth Enzymol 182:626–646 (1990); Rattan et al., Ann NY Acad Sci 663:48–62 (1992).)

"SEQ ID NO:X" refers to a polynucleotide sequence while "SEQ ID NO:Y" refers to a polypeptide sequence, both sequences identified by an integer specified in Table 1.

"A polypeptide having biological activity" refers to polypeptides exhibiting activity similar, but not necessarily identical to, an activity of a polypeptide of the present invention, including mature forms, as measured in a particular biological assay, with or without dose dependency. In the case where dose dependency does exist, it need not be identical to that of the polypeptide, but rather substantially similar to the dose-dependence in a given activity as compared to the polypeptide of the present invention (i.e., the candidate polypeptide will exhibit greater activity or not more than about 25-fold less and, preferably, not more than about tenfold less activity, and most preferably, not more than about three-fold less activity relative to the polypeptide of the present invention.)

Polynucleotides and Polypeptides of the Invention
Features of Protein Encoded by Gene No: 1

This gene is expressed primarily in testes tumor and to a lesser extent in fetal brain.

Therefore, polynucleotides and polypeptides of the invention are useful as reagents for differential identification of the tissue(s) or cell type(s) present in a biological sample and for diagnosis of diseases and conditions which include, but are not limited to, cancer particularly of the testes, and defects of the central nervous system such as seizure and neurodegenerative disorders. Similarly, polypeptides and antibodies directed to these polypeptides are useful in providing immunological probes for differential identification of the tissue(s) or cell type(s). For a number of disorders of the above tissues or cells, particularly cancer of the testes and central nervous system, expression of this gene at significantly higher or lower levels may be routinely detected in certain tissues and cell types (e.g. testes and other reproductive tissue, brain and other tissue of the nervous system, and blood cells, and spleen, and cancerous and wounded tissues) or bodily fluids (e.g.lymph, amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for the treatment/diagnosis of testicular cancer and the treatment of central nervous system disorders since this gene is primarily expressed in the testes tumor and developing brain. Alternatively, expression within fetal tissue and other cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:11 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1005 of SEQ ID NO:11, b is an integer of 15 to 1019, where both a and b correspond to the positions of nucleotide residues shown in SEQ ID NO:11, and where the b is greater than or equal to a+14.

Features of Protein Encoded by Gene No: 2

This gene is expressed primarily in cancer tissues, such as breast cancer, Wilm's tumor, and to a lesser extent in fetal tissues.

Therefore, polynucleotides and polypeptides of the invention are useful as reagents for differential identification of the tissue(s) or cell type(s) present in a biological sample and for diagnosis of diseases and conditions which include, but are not limited to, tumors, particularly, those found in the breast, or developmental abnormalities or disorders. Similarly, polypeptides and antibodies directed to these polypeptides are useful in providing immunological probes for differential identification of the tissue(s) or cell type(s). For a number of disorders of the above tissues or cells, particularly of the glandular tissues, expression of this gene at significantly higher or lower levels may be routinely detected in certain tissues and cell types (e.g. mammary tissue, fetal tissue, developmental tissue, and cancerous and wounded tissues) or bodily fluids (e.g.breast milk, amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in breast cancer cells indicates that polynucleotides and polypeptides corresponding to this gene are useful for the treatment/diagnosis of cancers and/or tumors, particularly, those found in the breast since expression is mainly in cancer/tumor tissues. Similarly, expression within embryonic tissue and other cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Preferred epitopes include those comprising a sequence shown in SEQ ID NO.321 as residues: Pro-11 to Thr-18, Leu-43 to Pro-50, Gly-64 to Leu-72, Leu-81 to Lys-86.

Many polynucleotide sequences, such as EST sequences, are publicly available and accessible through sequence databases. Some of these sequences are related to SEQ ID NO:12 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 451 of SEQ ID NO:12, b is an integer of 15 to 465, where both a and b correspond to the positions of nucleotide residues shown in SEQ ID NO:12, and where the b is greater than or equal to a+14.

Features of Protein Encoded by Gene No: 3

The gene encoding the disclosed cDNA is believed to reside on chromosome 11. Accordingly, polynucleotides related to this invention are useful as a marker in linkage analysis for chromosome 11.

This gene is expressed primarily in CD34 depleted buffy coat, and to a lesser extent in spleen, chronic lymphocytic leukemia.

Therefore, polynucleotides and polypeptides of the invention are useful as reagents for differential identification of the tissue(s) or cell type(s) present in a biological sample and for diagnosis of diseases and conditions: blood disorders or leukemias, diseases of the immune or hematopoietic system. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues and cell types (e.g., blood cells, and spleen, and cancerous and wounded tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution suggests that the protein product of this clone would be useful for the diagnosis and treatment of a variety of immune system disorders. Expression of this gene product in spleen and leukemia cells suggests a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersentivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:13 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 460 of SEQ ID NO:13, b is an integer of 15 to 474, where both a and b correspond to the positions of nucleotide residues shown in SEQ ID NO:13, and where the b is greater than or equal to a+14.

Features of Protein Encoded by Gene No: 4

This gene is expressed primarily in CD34 depleted buffy coat.

Therefore, polynucleotides and polypeptides of the invention are useful as reagents for differential identification of the tissue(s) or cell type(s) present in a biological sample and for diagnosis of diseases and conditions: immune or hematopoietic disorders, particularly lymphocytic diseases. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues and cell types (e.g., blood cells, and cancerous and wounded tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in CD34 depleted buffy coat suggests that the protein product of this clone would be useful for the treatment and diagnosis of hematopoetic related disorders such as anemia, pancytopenia, leukopenia, thrombocytopenia or leukemia since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:14 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 300 of SEQ ID NO:14, b is an integer of 15 to 314, where both a and b correspond to the positions of nucleotide residues shown in SEQ ID NO:14, and where the b is greater than or equal to a+14.

Features of Protein Encoded by Gene No: 5

This gene is expressed primarily in CD34 depleted buffy coat.

Therefore, polynucleotides and polypeptides of the invention are useful as reagents for differential identification of the tissue(s) or cell type(s) present in a biological sample and for diagnosis of diseases and conditions: immune or hematopoietic disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues and cell types (e.g., blood cells, immune, hematopoietic, and cancerous and wounded tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in CD34 depleted buffy coat suggests that the protein product of this clone would be useful for the treatment and diagnosis of hematopoetic related disorders such as anemia, pancytopenia, leukopenia, thrombocytopenia or leukemia since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Preferred epitopes include those comprising a sequence shown in SEQ ID NO.324 as residues: Pro-13 to Lys-21.

Many polynucleotide sequences, such as EST sequences, are publicly available and accessible through sequence databases. Some of these sequences are related to SEQ ID NO:15 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 599 of SEQ ID NO:15, b is an integer of 15 to 613, where both a and b correspond to the positions of nucleotide residues shown in SEQ ID NO:15, and where the b is greater than or equal to a+14.

Features of Protein Encoded by Gene No: 6

This gene is expressed primarily in CD34 depleted buffy coat.

Therefore, polynucleotides and polypeptides of the invention are useful as reagents for differential identification of the tissue(s) or cell type(s) present in a biological sample and for diagnosis of diseases and conditions: immune or hematopoietic disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues and cell types (e.g.immune, hematopoietic, and cancerous and wounded tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder. Preferred epitopes include those comprising a sequence shown in SEQ ID NO.318 as residues: Lys-31 to Lys-39.

The tissue distribution in CD34 depleted buffy coat suggests that the protein product of this clone would be useful for the treatment and diagnosis of hematopoetic related disorders such as anemia, pancytopenia, leukopenia, thrombocytopenia or leukemia since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Preferred epitopes include those comprising a sequence shown in SEQ ID NO.325 as residues: Lys-31 to Lys-39.

Many polynucleotide sequences, such as EST sequences, are publicly available and accessible through sequence databases. Some of these sequences are related to SEQ ID NO:16 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 342 of SEQ ID NO:16, b is an integer of 15 to 356, where both a and b correspond to the positions of nucleotide residues shown in SEQ ID NO:16, and where the b is greater than or equal to a+14.

Features of Protein Encoded by Gene No: 7

This gene is expressed primarily in CD34 depleted buffy coat, and to a lesser extent in the pineal gland.

Therefore, polynucleotides and polypeptides of the invention are useful as reagents for differential identification of the tissue(s) or cell type(s) present in a biological sample and for diagnosis of diseases and conditions: immune, hematopoietic, neural, or endocrine disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues and cell types (e.g.immune, blood cells, endocrine, neural, and cancerous and wounded tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in CD34 depleted buffy coat suggests that the protein product of this clone would be useful for the treatment and diagnosis of hematopoetic related disorders such as anemia, pancytopenia, leukopenia, thrombocytopenia or leukemia since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types.

Alternatively, expression within the pineal gland suggests that the protein product of this clone would be useful for the detection, treatment, and/or prevention of various endocrine disorders and cancers, particularly Addison's disease, Cushing's Syndrome, and disorders and/or cancers of the pancrease (e.g. diabetes mellitus), adrenal cortex, ovaries, pituitary (e.g., hyper-, hypopituitarism), thyroid (e.g. hyper-, hypothyroidism), parathyroid (e.g. hyper-, hypoparathyroidism), hypothallamus, and testes. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:17 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 400 of SEQ ID NO:17, b is an integer of 15 to 414, where both a and b correspond to the positions of nucleotide residues shown in SEQ ID NO:17, and where the b is greater than or equal to a+14.

Features of Protein Encoded by Gene No: 8

The translation product of this gene shares sequence homology with an organic cation transporter which is thought to be important in organic cation uptake in the kidney and liver. (See Accession No. 2343059.) Preferred polypeptide fragments comprise the amino acid sequence ITIAIQMICLVNXELYPTFVRNXGVMVC-SSLCDIGGIITPFVFRL REVWQALPLILFAVLGL-LAAGVTLLLPETKGVALPETMKDAEN-LGRKAKPKENTIYLKVQ TSEPSGT (SEQ ID NO:629) or TMKDAENLGRKAKPKENT (SEQ ID NO:630) as well as N-terminal and C-terminal deletions of these fragments. Also preferred are polynucleotide fragments encoding these polypeptide fragments.

This gene is expressed primarily in liver.

Therefore, polynucleotides and polypeptides of the invention are useful as reagents for differential identification of the tissue(s) or cell type(s) present in a biological sample and for diagnosis of diseases and conditions: hepatic and renal diseases where drug elimination/cation exchange (organic cation uptake) in the liver and kidney are problematic. Similarly, polypeptides and antibodies directed to these polypeptides are useful in providing immunological probes for differential identification of the tissue(s) or cell type(s). For a number of disorders of the above tissues or cells, particularly of the hepatic or renal system, expression of this gene at significantly higher or lower levels may be routinely detected in certain tissues and cell types (e.g., kidney and liver, and cancerous and wounded tissues) or bodily fluids (e.g.bile, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to organic cation transporter indicate that polynucleotides and polypeptides corresponding to this gene are useful as a polyspecific transporter that is important for drug elimination in the liver (and possibly kidney) since expression is found in the liver. Similarly, the tissue distribution in liver suggests that the protein product of this clone would be useful for the detection and treatment of liver disorders and cancers (e.g. hepatoblastoma, jaundice, hepatitis, liver metabolic diseases and conditions that are attributable to the differentiation of hepatocyte progenitor cells). In addition the expression in fetus would suggest a useful role for the protein product in developmental abnormalities, fetal deficiencies, pre-natal disorders and variouswould-healing models and/or tissue trauma. Moreover, the homology to the organic ion transporter may suggest that this gene or gene product could be used in the treatment and/or detection of kidney diseases including renal failure, nephritus, renal tubular acidosis, proteinuria, pyuria, edema, pyelonephritis, hydronephritis, nephrotic syndrome, crush syndrome, glomerulonephritis, hematuria, renal colic and kidney stones, in addition to Wilms Tumor Disease, and congenital kidney abnormalities such as horseshoe kidney, polycystic kidney, and Falconi's syndrome. Protein, as well as, antibodies directed against the protein may show utility as a tumor marker and/or immunotherapy targets for the above listed tissues.

Preferred epitopes include those comprising a sequence shown in SEQ ID NO.327 as residues: Asn-64 to Asn-74, Gln-81 to Gly-87.

Many polynucleotide sequences, such as EST sequences, are publicly available and accessible through sequence databases. Some of these sequences are related to SEQ ID NO:18 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 455 of SEQ ID NO:18, b is an integer of 15 to 469, where both a and b correspond to the positions of nucleotide residues shown in SEQ ID NO:18, and where the b is greater than or equal to a+14.

Features of Protein Encoded by Gene No: 9

This gene is expressed primarily in eosinophils induced with IL-5, and to a lesser extent in fetal liver and spleen. The gene encoding the disclosed cDNA is believed to reside on chromosome 15. Accordingly, polynucleotides related to this invention are useful as a marker in linkage analysis for chromosome 15.

Therefore, polynucleotides and polypeptides of the invention are useful as reagents for differential identification of the tissue(s) or cell type(s) present in a biological sample and for diagnosis of diseases and conditions: diseases of the immune system, particularly allergies or asthma, in addition to hepatic, or developmental disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues and cell types (e.g., blood cells, liver, and spleen, and cancerous and wounded tissues) or bodily fluids (e.g.lymph, amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for treating/diagnosis of diseases involving esosinphil reactions since expression seems to be concentrated in eosinophils and other tissues involved in immunity such as the liver and spleen. Similarly, expression within embryonic tissue and other cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:19 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 536 of SEQ ID NO:19, b is an integer of 15 to 550, where both a and b correspond to the positions of nucleotide residues shown in SEQ ID NO:19, and where the b is greater than or equal to a+14.

Features of Protein Encoded by Gene No: 10

This gene is expressed primarily in tissues of hematopoietic lineage and to a lesser extent in Hodgkins lymphoma. Any frame shifts in this sequence can easily be clarified using known molecular biology techniques.

Therefore, polynucleotides and polypeptides of the invention are useful as reagents for differential identification of the tissue(s) or cell type(s) present in a biological sample and for the diagnosis of diseases and conditions which include, but are not limited to, immune deficiencies or dysfunctions. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues and cell types (e.g., hematopoietic cells, lymphoid and reticuloendothelial tissues, and cancerous tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for treatment/diagnosis for lymphomas or immune dysfunction or as a therapeutic protein useful in immune modulation based on expression in anergic T-cells and lymphomas. Protein, as well as, antibodies directed against the protein may show utility as a tumor marker and/or immunotherapy targets for the above listed tissues.

Preferred epitopes include those comprising a sequence shown in SEQ ID NO.18 as residues: Gly-6 to Asp-7, Pro-20 to Ser-21, Ser-23 to Cys-24, Arg-26 to Arg-26.

Many polynucleotide sequences, such as EST sequences, are publicly available and accessible through sequence databases. Some of these sequences are related to SEQ ID NO:20 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 759 of SEQ ID NO:20, b is an integer of 15 to 773, where both a and b correspond to the positions of nucleotide residues shown in SEQ ID NO:20, and where the b is greater than or equal to a+14.

Features of Protein Encoded by Gene No: 11

This gene is expressed primarily in neutrophils and to a lesser extent in activated lymphoid cells.

Therefore, polynucleotides and polypeptides of the invention are useful as reagents for differential identification of the cell type present in a biological sample and for diagnosis of diseases and conditions: immune or hematopoietic disorders, particularly inflammatory conditions. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues and cell types (e.g., blood cells and lymphoid tissue, immune, and cancerous and wounded tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution suggests that the protein product of this clone would be useful for the treatment and diagnosis of hematopoetic related disorders such as anemia, pancytopenia, leukopenia, thrombocytopenia or leukemia since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Preferred epitopes include those comprising a sequence shown in SEQ ID NO.330 as residues: Glu40 to Lys-46.

Many polynucleotide sequences, such as EST sequences, are publicly available and accessible through sequence databases. Some of these sequences are related to SEQ ID NO:21 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 977 of SEQ ID NO:21, b is an integer of 15 to 991, where both a and b correspond to the positions of nucleotide residues shown in SEQ ID NO:21, and where the b is greater than or equal to a+14.

Features of Protein Encoded by Gene No: 12

This gene is expressed primarily in brain and to a lesser extent in activated T-cells. It is likely that the open reading frame containing the predicted signal peptide continues in the 5' direction. Preferred polypeptide fragments comprise the amino acid sequence PRVRNSPEDLGLSLTGDSCKL (SEQ ID NO:631).

Therefore, polynucleotides and polypeptides of the invention are useful as reagents for differential identification of the tissue(s) or cell type(s) present in a biological sample and for diagnosis of diseases and conditions: immune or neurodegenerative disorders including ischemic shock, alzheimers and cognitive disorders. Similarly, polypeptides and antibodies directed to these polypeptides are useful in providing immunological probes for differential identification of the tissue(s) or cell type(s). For a number of disorders of the above tissues or cells, particularly of the central nervous system, expression of this gene at significantly higher or lower levels may be routinely detected in certain tissues and cell types (e.g., blood cells, brain, other tissue of the nervous system, and cancerous and wounded tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in brain suggests that the protein product of this clone would be useful for the detection/treatment of neurodegenerative disease states, behavioural disorders, or inflammatory conditions such as Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, panic disorder, learning disabilities, ALS, psychoses , autism, and altered bahaviors, including disorders in feeding, sleep patterns, balance, and preception. In addition, the gene or gene product may also play a role in the treatment and/or detection of developmental disorders associated with the developing embryo, sexually-linked disorders, or disorders of the cardiovascular system.

Alternatively, the tissue distribution in activated T-cells suggests that the protein product of this clone would be useful for the diagnosis and treatment of a variety of immune system disorders. Expression of this gene product in tonsils suggests a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersentivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Preferred epitopes include those comprising a sequence shown in SEQ ID NO.331 as residues: Ser-5 to Glu-14, Ile-21 to Pro-35, Ser-65 to Asp-81, Cys-89 to Val-96, Lys-136 to Ser-145, Ile-152 to Met-169, Arg-189 to Lys-196.

Many polynucleotide sequences, such as EST sequences, are publicly available and accessible through sequence databases. Some of these sequences are related to SEQ ID NO:22 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 639 of SEQ ID NO:22, b is an integer of 15 to 653, where both a and b correspond to the positions of nucleotide residues shown in SEQ ID NO:22, and where the b is greater than or equal to a+14.

Features of Protein Encoded by Gene No: 13

This gene was also recently cloned by other groups, naming this calcium-activated potassium channel gene, hKCa4. (See Accession No. AF033021, see also, Accession No. 2584866.) This gene is mapped to human chromosome 19q13.2. A second signal sequence likely exists upstream from the predicted signal sequence as described in Table 1. Preferred polypeptide fragments comprise: QADDLQATVAALCVLRGGGPWAGSWLSPKTPGAM GGDLVLGLGALRRRKRLL (SEQ NO:632); or EQEKSLAGWALVLAXXGIGLMVLH AEMLWFGGCSAVNATGHLSDTLWLIPITIGYGDV-VPGTMWGKIVCLCTGVMG VCCTALLVAVVARKLEFNKAEKHVHNFM-MDIQYTKEMKESAARVLQEAWMFYKHTRR KESHAARXHQRXLLAAINAFRQVR-LKHRKLREQVNSMVDISKMHMILYDLQQNLSSSHR ALEKQIDTLAGKLDALTELLSTALGPRQLPEPSQQSK (SEQ ID NO:633), as well as N-terminal and C-terminal deletions. Also preferred are polynulcleotide fragments encoding these polypeptide fragments.

This gene is expressed primarily in breast lymph node and T-cells, and to a lesser extent in placenta.

Therefore, polynucleotides and polypeptides of the invention are useful as reagents for differential identification of the tissue(s) or cell type(s) present in a biological sample and for diagnosis of diseases and conditions: hematologic, immune, reproductive, or developmental disorders. Similarly, polypeptides and antibodies directed to these polypeptides are useful in providing immunological probes for differential identification of the tissue(s) or cell type(s). For a number of disorders of the above tissues or cells, particularly of the immune or reproductive system, expression of this gene at significantly higher or lower levels may be routinely detected in certain tissues and cell types (e.g., lymphoid tissue, blood cells and placenta, neural, and cancerous and wounded tissues) or bodily fluids (e.g.lymph, amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder. Preferred epitopes include those comprising a sequence shown in SEQ ID NO.325 as residues: Arg-13 to Lys-23.

The tissue distribution suggests that the protein product of this clone would be useful for the diagnosis and treatment of a variety of immune system disorders. Expression of this gene product in tonsils suggests a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersentivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types.

Alternatively, expression within placental tissue and other cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Preferred epitopes include those comprising a sequence shown in SEQ ID NO.332 as residues: Arg-13 to Lys-23.

Many polynucleotide sequences, such as EST sequences, are publicly available and accessible through sequence databases. Some of these sequences are related to SEQ ID NO:23 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1472 of SEQ ID NO:23, b is an integer of 15 to 1486, where both a and b correspond to the positions of nucleotide residues shown in SEQ ID NO:23, and where the b is greater than or equal to a+14.

Features of Protein Encoded by Gene No: 14

The translation product of this gene was found to have homology with the human PAPS synethase, which is believed to be involved in modification of L-selectin ligands (See Accession No. e1204135.) Preferred polypeptide fragments comprise the amino acid sequence YQAHHVSRNKRGQVVGTRGGFRGCTVWLTGLSGAGK (SEQ ID NO:634), SPFLLPGEVPASRGGSGPSPFSFSLRID-VLPPPPPPSRVLRSLLPGPGSAQP ASMSGIKKQKTEN-QQKSTNVVYQAHHVSRNKRGQVVGTRGG-FRGCTVWLTG LSGAGKNNDKFCPGGVLVSHAIPVN-SWMGTMSVMALTESPRWLHGPQSMEGPDRLLQ VPAEELSLWSRVSF (SEQ ID NO:635), VLPWRSTCLPCHPC (SEQ ID NO:636), or FLDGDNVRHGLN-RIPQMASWPPKHGRS (SEQ ID NO:637). Also preferred are the polynucleotide fragments encoding this polypeptide fragment.

It has been discovered that this gene is expressed primarily in benign prostate hyperplasia, human umbilical vein endothelial cells and to a lesser extent in smooth muscle and human endometrial stromal cells-treated with estradiol.

Therefore, polynucleotides and polypeptides of the invention are useful as reagents for differential identification of the tissue(s) or cell type(s) present in a biological sample and for diagnosis of diseases and conditions: inflamation, ischemia, and restenosis, based on endothelial cell and smooth muscle cell expression, and prostate diseases such as benign prostate hyperplasia or prostate cancer. Similarly, polypeptides and antibodies directed to these polypeptides are useful in providing immunological probes for differential identification of the tissue(s) or cell type(s). For a number of disorders of the above tissues or cells, particularly of the prostate or vessels of the circulatory system, expression of this gene at significantly higher or lower levels may be routinely detected in certain tissues and cell types (e.g., prostate, endothelial cells, smooth muscle, and endometrium, and cancerous and wounded tissues) or bodily fluids (e.g.seminal fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for treating/diagnosing diseases or conditions where the endothelial cell lining of the veins and arteries of underlying smooth muscle are involved. Alternatively, expression within prostate tissue suggests that the protein product of this clone may show utility in the study, detection, treatment, or prevention of a variety of reproductive disorders, particularly prostate cancer. Protein, as well as, antibodies directed against the protein may show utility as a tumor marker and/or immunotherapy targets for the above listed tissues.

Preferred epitopes include those comprising a sequence shown in SEQ ID NO.333 as residues: Arg-21 to Asp-26, Lys-35 to Lys-44, Glu-49 to Asn-58.

Many polynucleotide sequences, such as EST sequences, are publicly available and accessible through sequence databases. Some of these sequences are related to SEQ ID NO:24 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2309 of SEQ ID NO:24, b is an integer of 15 to 2323, where both a and b correspond to the positions of nucleotide residues shown in SEQ ID NO:24, and where the b is greater than or equal to a+14.

Features of Protein Encoded by Gene No: 15

This gene is expressed primarily in human 6 week embryo, and to a lesser extent in placenta.

Therefore, polynucleotides and polypeptides of the invention are useful as reagents for differential identification of the tissue(s) or cell type(s) present in a biological sample and for diagnosis of diseases and conditions: reproductive disorders, particularly developmental anomalies or fetal deficiencies. Similarly, polypeptides and antibodies directed to these polypeptides are useful in providing immunological probes for differential identification of the tissue(s) or cell type(s). For a number of disorders of the above tissues or cells, particularly reproductive or developmental in nature, expression of this gene at significantly higher or lower levels may be routinely detected in certain tissues and cell types (e.g., embryonic tissue, developing, differentiating, placenta, and cancerous and wounded tissues) or bodily fluids (e.g.amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution within human embryonic, placental, and other cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Preferred epitopes include those comprising a sequence shown in SEQ ID NO.334 as residues: Lys-50 to Glu-57.

Many polynucleotide sequences, such as EST sequences, are publicly available and accessible through sequence databases. Some of these sequences are related to SEQ ID NO:25 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 669 of SEQ ID NO:25, b is an integer of 15 to 683, where both a and b correspond to the positions of nucleotide residues shown in SEQ ID NO:25, and where the b is greater than or equal to a+14.

Features of Protein Encoded by Gene No: 16

This gene is expressed primarily in kidney, amygdala, and to a lesser extent in fetal tissues. The gene encoding the disclosed cDNA is believed to reside on chromosome 14. Accordingly, polynucleotides related to this invention are useful as a marker in linkage analysis for chromosome 14.

Therefore, polynucleotides and polypeptides of the invention are useful as reagents for differential identification of the tissue(s) present in a biological sample and for diagnosis of diseases and conditions: kidney diseases, neurological disorders and developmental abnormalities. Similarly, polypeptides and antibodies directed to these polypeptides are useful in providing immunological probes for differential identification of the tissue(s). For a number of disorders of the above tissues, particularly of the renal system or developing fetal tissues, expression of this gene at significantly higher or lower levels may be routinely detected in certain tissues and cell types (e.g., kidney, amygdala, and fetal tissues, and cancerous and wounded tissues) or bodily fluids (e.g., amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in kidney suggests that this gene or gene product could be used in the treatment and/or detection of kidney diseases including renal failure, nephritus, renal tubular acidosis, proteinuria, pyuria, edema, pyelonephritis, hydronephritis, nephrotic syndrome, crush syndrome, glomerulonephritis, hematuria, renal colic and kidney stones, in addition to Wilms Tumor Disease, and congenital kidney abnormalities such as horseshoe kidney, polycystic kidney, and Falconi's syndrome. Similarly, expression within neural tissue suggests that that the protein product of this clone would be useful for the detection/treatment of neurodegenerative disease states, behavioural disorders, or inflammatory conditions such as Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, panic disorder, learning disabilities, ALS, psychoses, autism, and altered bahaviors, including disorders in feeding, sleep patterns, balance, and preception. In addition, the gene or gene product may also play a role in the treatment and/or detection of developmental disorders associated with the developing embryo, sexually-linked disorders, or disorders of the cardiovascular system. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:26 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2022 of SEQ ID NO:26, b is an integer of 15 to 2036, where both a and b correspond to the positions of nucleotide residues shown in SEQ ID NO:26, and where the b is greater than or equal to a+14.

Features of Protein Encoded by Gene No: 17

This gene is expressed primarily in ovarian cancer.

Therefore, polynucleotides and polypeptides of the invention are useful as reagents for differential identification of the tissue(s) or cell type(s) present in a biological sample and for diagnosis of diseases and conditions: reproductive disorders, particularly solid tumors similar to ovarian cancer. Similarly, polypeptides and antibodies directed to these polypeptides are useful in providing immunological probes for differential identification of the tissue(s) or cell type(s). For a number of disorders of the above tissues or cells, particularly of the reproductive system. expression of this gene at significantly higher or lower levels may be routinely detected in certain tissues and cell types (e.g., ovarian and other reproductive tissue, and cancerous and wounded tissues) or bodily fluids (e.g.lymph, amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for the treatment of solid tumors of the reproductive system such as ovarian cancer. Similarly, expression within cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Preferred epitopes include those comprising a sequence shown in SEQ ID NO.336 as residues: Ser-51 to Val-56.

Many polynucleotide sequences, such as EST sequences, are publicly available and accessible through sequence databases. Some of these sequences are related to SEQ ID NO:27 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 703 of SEQ ID NO:27, b is an integer of 15 to 717, where both a and b correspond to the positions of nucleotide residues shown in SEQ ID NO:27, and where the b is greater than or equal to a+14.

Features of Protein Encoded by Gene No: 18

This gene is expressed primarily in brain medulloblastoma. Preferred polypeptide fragments comprise the amino acid sequence: IRHEQHPNFSLEMHSKGSSLLLFLPQL ILILPVCAHLHEELNC (SEQ ID NO:638) and SFFI-SEEKGHLLLQAERHPWVAGA LVGVSGGLTLTTCS-GPTEKPATKNYFLKRLLQEMHIRAN (SEQ ID NO:639), as well as N-terminal and C-terminal deletions. Also preferred are polynucleotide fragments encoding these polypeptide fragments.

Therefore, polynucleotides and polypeptides of the invention are useful as reagents for differential identification of the tissue(s) or cell type(s) present in a biological sample and for diagnosis of diseases and conditions: neural disorders, particularly tumors of the CNS. Similarly, polypeptides and antibodies directed to these polypeptides are useful in providing immunological probes for differential identification of the tissue(s) or cell type(s). For a number of disorders of the above tissues or cells, particularly of the Central nervous system, expression of this gene at significantly higher or lower levels may be routinely detected in certain tissues and cell types (e.g., brain and other tissue of the nervous system, and cancerous and wounded tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution suggests that the protein product of this clone would be useful for the detection/treatment of neurodegenerative disease states, behavioural disorders, or inflammatory conditions such as Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, panic disorder, learning disabilities, ALS, psychoses , autism, and altered bahaviors, including disorders in feeding, sleep patterns, balance, and preception. In addition, the gene or gene product may also play a role in the treatment and/or detection of developmental disorders associated with the developing embryo, sexually-linked disorders, or disorders of the cardiovascular system. Similarly, expression within cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:28 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 481 of SEQ ID NO:28, b is an integer of 15 to 495, where both a and b correspond to the positions of nucleotide residues shown in SEQ ID NO:28, and where the b is greater than or equal to a+14.

Features of Protein Encoded by Gene No: 19

This gene is expressed primarily in adipocytes.

Therefore, polynucleotides and polypeptides of the invention are useful as reagents for differential identification of the tissue(s) or cell type(s) present in a biological sample and for diagnosis of diseases and conditions: obesity. Similarly, polypeptides and antibodies directed to these polypeptides are useful in providing immunological probes for differential identification of the tissue(s) or cell type(s). For a number of disorders of the above tissues or cells, particularly of the adipose tissues expression of this gene at significantly higher or lower levels may be routinely detected in certain tissues and cell types (e.g., adipocytes and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for treating metabolic disorders, particularly obesity by regulating the function and number of adipocytes. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:29 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 542 of SEQ ID NO:29, b is an integer of 15 to 556, where both a and b correspond to the positions of nucleotide residues shown in SEQ ID NO:29, and where the b is greater than or equal to a+14.

Features of Protein Encoded by Gene No: 20

This gene is expressed primarily in B cell lymphoma.

Therefore, polynucleotides and polypeptides of the invention are useful as reagents for differential identification of the tissue(s) or cell type(s) present in a biological sample and for diagnosis of diseases and conditions which include, but are not limited to, the immune system with an emphasis on B cell lymphoma. Similarly, polypeptides and antibodies directed to these polypeptides are useful in providing immunological probes for differential identification of the tissue(s) or cell type(s). For a number of disorders of the above tissues or cells, particularly of the tumors of the immune system, expression of this gene at significantly higher or lower levels may be routinely detected in certain tissues and cell types (e.g., blood cells, and lymphoid tissue, and cancerous and wounded tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution suggests that the protein product of this clone would be useful for the diagnosis and treatment of a variety of immune system disorders, particularly for diagnosis and treatment of B cell derived tumors. Expression of this gene product in B-cells suggests a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersentivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:30 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 420 of SEQ ID NO:30, b is an integer of 15 to 434, where both a and b correspond to the positions of nucleotide residues shown in SEQ ID NO:30, and where the b is greater than or equal to a+14.

Features of Protein Encoded by Gene No: 21

It is likely that the open reading frame containing the predicted signal peptide continues in the 5' direction.

Therefore, in specific embodiments, polypeptides of the invention comprise the following amino acid sequence: TRPISQLRHYCEPYITWCQE TYSQTKPK (SEQ ID NO:640). Polynucleotides encoding these polypeptides are also encompassed by the invention.

This gene is expressed primarily in immune cells, and to a lesser extent in fetal tissues Therefore, polynucleotides and polypeptides of the invention are useful as reagents for differential identification of the tissue(s) or cell type(s) present in a biological sample and for diagnosis of diseases and conditions: immune or reproductive disorders, particularly inflammatory or developmental disorders. Similarly, polypeptides and antibodies directed to these polypeptides are useful in providing immunological probes for differential identification of the tissue(s) or cell type(s). For a number of disorders of the above tissues or cells, particularly of the immune expression of this gene at significantly higher or lower levels may be routinely detected in certain tissues and cell types (e.g., cells of the immune system, and fetal tissues, and cancerous and wounded tissues) or bodily fluids (e.g.lymph, amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution suggests that the protein product of this clone would be useful for the diagnosis and treatment of a variety of immune system disorders. Expression of this gene product in immune cells suggests a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersentivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types. Similarly, expression within fetal tissue and other cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Preferred epitopes include those comprising a sequence shown in SEQ ID NO.340 as residues: Asp-10 to Pro-19, Ser-74 to Tyr-79, Glu-95 to Lys-110.

Many polynucleotide sequences, such as EST sequences, are publicly available and accessible through sequence databases. Some of these sequences are related to SEQ ID NO:31 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 701 of SEQ ID NO:31, b is an integer of 15 to 715, where both a and b correspond to the positions of nucleotide residues shown in SEQ ID NO:31, and where the b is greater than or equal to a+14.

Features of Protein Encoded by Gene No: 22

It is likely that the open reading frame containing the predicted signal peptide continues in the 5' direction. Therefore, in specific embodiments, polypeptides of the invention comprise the following amino acid sequence: SQCRRKGTFLYFLPQTLS PHTSCPCSAGRPLPPPVLD-STPSSPSN (SEQ ID NO:641). Polynucleotides encoding these polypeptides are also encompassed by the invention.

It has been discovered that this gene is expressed primarily in ovarian tumor.

Therefore, polynucleotides and polypeptides of the invention are useful as reagents for differential identification of the tissue(s) or cell type(s) present in a biological sample and for diagnosis of diseases and conditions: reproductive or endocrine disorders, particularly tumors of the ovary. Similarly, polypeptides and antibodies directed to these polypeptides are useful in providing immunological probes for differential identification of the tissue(s) or cell type(s). For a number of disorders of the above tissues or cells, particularly of tumors of the reproductive organs. expression of this gene at significantly higher or lower levels may be routinely detected in certain tissues and cell types (e.g., ovarian and other reproductive tissue and cancerous and wounded tissues) or bodily fluids (e.g.lymph, amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for diagnosis, treatment, and/or prevention of a variety of reproductive or endocrine disorders, particularly ovarian. Protein, as well as, antibodies directed against the protein may show utility as a tissue-specific marker and/or immunotherapy target for the above listed tissues.

Preferred epitopes include those comprising a sequence shown in SEQ ID NO.341 as residues: Leu-22 to Gln-27.

Many polynucleotide sequences, such as EST sequences, are publicly available and accessible through sequence databases. Some of these sequences are related to SEQ ID NO:32 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 472 of SEQ ID NO:32, b is an integer of 15 to 486, where both a and b correspond to the positions of nucleotide residues shown in SEQ ID NO:32, and where the b is greater than or equal to a+14.

Features of Protein Encoded by Gene No: 23

The gene encoding the disclosed cDNA is believed to reside on chromosome 1. Accordingly, polynucleotides related to this invention are useful as a marker in linkage analysis for chromosome 1.

It has been discovered that this gene is expressed primarily in fetal tissues, and to a lesser extent in osteoclastoma cell line.

Therefore, polynucleotides and polypeptides of the invention are useful as reagents for differential identification of the tissue(s) or cell type(s) present in a biological sample and for diagnosis of diseases and conditions: osteoporosis or arthritis. Similarly, polypeptides and antibodies directed to these polypeptides are useful in providing immunological probes for differential identification of the tissue(s) or cell type(s). For a number of disorders of the above tissues or cells, particularly of the skeletal expression of this gene at significantly higher or lower levels may be routinely detected in certain tissues and cell types (e.g., bone cells, fetal tissue, developmental, and cancerous and wounded tissues) or bodily fluids (e.g.lymph, amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for treatment of conditions of a variety of skeletal disorders, particularly abnormal bone remodeling due to enhanced activity of osteoclasts. This may be useful as a specific marker for malignancies derived from osteoclasts or their precursors. Alternatively, expression within fetal tissues and other cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:33 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 711 of SEQ ID NO:33, b is an integer of 15 to 725, where both a and b correspond to the positions of nucleotide residues shown in SEQ ID NO:33, and where the b is greater than or equal to a+14.

Features of Protein Encoded by Gene No: 24

The translation product of this gene shares sequence homology with a periplasmic ribonuclease which is thought to be important in degrading extracellular polynucleotides. In specific embodiments, polypeptides of the invention comprise the following amino acid sequence: HSMLPSD-V S I L Y H M K T L L L L Q D T E R L K H A L E M F P E-HCTMPPAFIGSCR NQIGRSSVPAAPNVEKYSRSIP-KEPTPMTWTQESYNLRGLFPSVHCRAHATHHL ACPDPRXATPCDNSR (SEQ ID NO:642). Polynucleotides encoding these polypeptides are also encompassed by the invention.

It has been discovered that this gene is expressed primarily in serum treated smooth muscle cells Therefore, polynucleotides and polypeptides of the invention are useful as reagents for differential identification of the tissue(s) or cell type(s) present in a biological sample and for diagnosis of diseases and conditions: vascular disease such as restenosis, atherosclerosis, stroke, or aneurysm. Similarly, polypeptides and antibodies directed to these polypeptides are useful in providing immunological probes for differential identification of the tissue(s) or cell type(s). For a number of disorders of the above tissues or cells, particularly of the vasculature expression of this gene at significantly higher or lower levels may be routinely detected in certain tissues and cell types (e.g., smooth muscle, vascular, and cancerous and wounded tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in smooth muscle and homology to ribonucleases indicate that polynucleotides and polypeptides corresponding to this gene are useful for treatment of pathological conditions of smooth muscle associated with bacterial or viral infiltration. Protein, as well as, antibodies directed against the protein may show utility as a tissue-specific marker and/or immunotherapy target for the above listed tissues.

Preferred epitopes include those comprising a sequence shown in SEQ ID NO.343 as residues: Gln-30 to Lys-36, Pro-41 to Arg-48.

Many polynucleotide sequences, such as EST sequences, are publicly available and accessible through sequence databases. Some of these sequences are related to SEQ ID NO:34 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 423 of SEQ ID NO:34, b is an integer of 15 to 437, where both a and b correspond to the positions of nucleotide residues shown in SEQ ID NO:34, and where the b is greater than or equal to a+14.

Features of Protein Encoded by Gene No: 25

This gene is expressed primarily in early stage human brain.

Therefore, polynucleotides and polypeptides of the invention are useful as reagents for differential identification of the tissue(s) or cell type(s) present in a biological sample and for diagnosis of diseases and conditions: neural or developmental disorders, particularly neurodegenerative or behavioral disorders. Similarly, polypeptides and antibodies directed to these polypeptides are useful in providing immunological probes for differential identification of the tissue(s) or cell type(s). For a number of disorders of the above tissues or cells, particularly of the human brain development and related diseases, expression of this gene at significantly higher or lower levels may be routinely detected in certain tissues and cell types (e.g., brain and other tissue of the nervous system, developmental, and cancerous and wounded tissues) or bodily fluids (e.g.lymph, amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in brain suggests that the protein product of this clone would be useful for the detection/treatment of neurodegenerative disease states, behavioural disorders, or inflammatory conditions such as Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, panic disorder, learning disabilities, ALS, psychoses, autism, and altered bahaviors, including disorders in feeding, sleep patterns, balance, and preception. In addition, the gene or gene product may also play a role in the treatment and/or detection of developmental disorders associated with the developing embryo, sexually-linked disorders, or disorders of the cardiovascular system. Alternatively, expression within fetal tissues and other cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Preferred epitopes include those comprising a sequence shown in SEQ ID NO.344 as residues: Pro-20 to Glu-25.

Many polynucleotide sequences, such as EST sequences, are publicly available and accessible through sequence databases. Some of these sequences are related to SEQ ID NO:35 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 929 of SEQ ID NO:35, b is an integer of 15 to 943, where both a and b correspond to the positions of nucleotide residues shown in SEQ ID NO:35, and where the b is greater than or equal to a+14.

Features of Protein Encoded by Gene No: 26

It has been discovered that this gene is expressed primarily in human brain tissue.

Therefore, polynucleotides and polypeptides of the invention are useful as reagents for differential identification of the tissue(s) or cell type(s) present in a biological sample and for diagnosis of diseases and conditions: neural disorders, particularly brain diseases, such as neurodegenerative disorders which may be caused by brain diseases. Similarly, polypeptides and antibodies directed to these polypeptides are useful in providing immunological probes for differential identification of the tissue(s) or cell type(s). For a number of disorders of the above tissues or cells, particularly of the human brain diseases, expression of this gene at significantly higher or lower levels may be routinely detected in certain tissues and cell types (e.g., brain and other tissue of the nervous system, and cancerous and wounded tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in brain suggests that the protein product of this clone would be useful for the detection/treatment of neurodegenerative disease states, behavioural disorders, or inflammatory conditions such as Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, panic disorder, learning disabilities, ALS, psychoses , autism, and altered bahaviors, including disorders in feeding, sleep patterns, balance, and preception. In addition, the gene or gene product may also play a role in the treatment and/or detection of developmental disorders associated with the developing embryo, sexually-linked disorders, or disorders of the cardiovascular system. Protein, as well as, antibodies directed against the protein may show utility as a tumor marker and/or immunotherapy targets for the above listed tissues.

Preferred epitopes include those comprising a sequence shown in SEQ ID NO.345 as residues: Glu-31 to Leu-36.

Many polynucleotide sequences, such as EST sequences, are publicly available and accessible through sequence databases. Some of these sequences are related to SEQ ID NO:36 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 590 of SEQ ID NO:36, b is an integer of 15 to 604, where both a and b correspond to the positions of nucleotide residues shown in SEQ ID NO:36, and where the b is greater than or equal to a+14.

Features of Protein Encoded by Gene No: 27

It has been discovered that this gene is expressed primarily in anergic T-cells.

Therefore, polynucleotides and polypeptides of the invention are useful as reagents for differential identification of the tissue(s) or cell type(s) present in a biological sample and for diagnosis of diseases and conditions: immune diseases, particularly inflammatory diseases and diseases related to T lymph cells, such as immunodeficiencies. Similarly, polypeptides and antibodies directed to these polypeptides are useful in providing immunological probes for differential identification of the tissue(s) or cell type(s). For a number of disorders of the above tissues or cells, particularly of the immune diseases, inflammatory diseases and diseases related to T lymph cells, expression of this gene at significantly higher or lower levels may be routinely detected in certain tissues and cell types (e.g., blood cells, and cancerous and wounded tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution suggests that the protein product of this clone would be useful for the diagnosis and treatment of a variety of immune system disorders. Expression of this gene product in T-cells suggests a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersentivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Preferred epitopes include those comprising a sequence shown in SEQ ID NO.346 as residues: Gly-26 to Ser-35.

Many polynucleotide sequences, such as EST sequences, are publicly available and accessible through sequence databases. Some of these sequences are related to SEQ ID NO:37 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 335 of SEQ ID NO:37, b is an integer of 15 to 349, where both a and b correspond to the positions of nucleotide residues shown in SEQ ID NO:37, and where the b is greater than or equal to a+14.

Features of Protein Encoded by Gene No: 28

The translation product of this gene shares sequence homology with *Shigella flexneri* positive transcriptional regulator CriR (criR) gene which part of a two-component regulatory pathway and is thought to be important in regulation of gene expression. Since there are multiple examples of prokaryotic two-component regulatory pathways that have significant parallels to signal transduction pathways in eukaryotic tissues, it is anticipated that this gene would have utlility for treating human disorders. In specific embodiments, polypeptides of the invention comprise the following amino acid sequence: LLHELVQAH YPGDVVF1TAASDMETVSEAVRCGVFDYLIKPIAY XXLGQTLTRFRQRKHMLESID SASQKQIDEMFNA-YARGEPKDELPTGIEPLTLNAVRKLFKX-PGVQHTAXTVXQALNHQP HHCQALS (SEQ ID NO:643), or TISRTTARRYLEYCASRHLIIAEIVH-GKVGR PQRIYHSG (SEQ ID NO:644). Polynucleotides encoding these polypeptides are also encompassed by the invention.

This gene is expressed primarily in human synovial sarcoma and normal human brain tissues.

Therefore, polynucleotides and polypeptides of the invention are useful as reagents for differential identification of the tissue(s) or cell type(s) present in a biological sample and for diagnosis of diseases and conditions: human brain diseases particularly sarcomas of the synovium. Similarly, polypeptides and antibodies directed to these polypeptides are useful in providing immunological probes for differential identification of the tissue(s) or cell type(s). For a number of disorders of the above tissues or cells, particularly of the human brain and synovium and other related human brain diseases, expression of this gene at significantly higher or lower levels may be routinely detected in certain tissues and cell types (e.g., synovial tissue, and brain and other tissue of the nervous system, and cancerous and wounded tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in brain, combined with the homology to a two-component regulatory protein suggests that the protein product of this clone would be useful for the detection/treatment of neurodegenerative disease states, behavioural disorders, or inflammatory conditions such as Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, panic disorder, learning disabilities, ALS, psychoses, autism, and altered bahaviors, including disorders in feeding, sleep patterns, balance, and preception. In addition, the gene or gene product may also play a role in the treatment and/or detection of developmental disorders associated with the developing embryo, sexually-linked disorders, or disorders of the cardiovascular system. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:38 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 658 of SEQ ID NO:38, b is an integer of 15 to 672, where both a and b correspond to the positions of nucleotide residues shown in SEQ ID NO:38, and where the b is greater than or equal to a+14.

Features of Protein Encoded by Gene No: 29

The gene encoding the disclosed cDNA is believed to reside on the X chromosome. Accordingly, polynucleotides related to this invention are useful as a marker in linkage analysis for the X chromosome.

This gene is expressed in bone marrow, infant brain, fetal liver and spleen, prostate and to a lesser extent in pineal gland, adipose tissue, kidney, adrenal gland, umbilical vein endothelial cells, and T cells.

Therefore, polynucleotides and polypeptides of the invention are useful as reagents for identification of the tissue(s)

or cell type(s) present in a biological sample and for diagnosis of diseases and conditions: diseases related to bone marrow or hematoplastic tissues, prostate, kidney, neural, adrenal gland, and cardiovascular tissue or organs. Similarly, polypeptides and antibodies directed to these polypeptides are useful in providing immunological probes for identification of the tissue(s) or cell type(s). For a number of disorders of the above tissues or cells, particularly of the diseases related to hematoplastic tissues, immune system, prostate, kidney, adrenal gland, and cardiovascular tissue or organs, expression of this gene at significantly higher or lower levels may be routinely detected in certain tissues and cell types (e.g., bone marrow, hematopoietic cells, pineal gland, adipose tissue, neural, developing, kidney, adrenal gland, endothelial cells, and blood cells, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to the gene indicate that polynucleotides and polypeptides corresponding to this gene are useful for diagnosis and treatment of diseases related to hematoplastic tissues, immune system, prostate, kidney, adrenal gland, and cardiovascular tissue or organs. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:39 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1894 of SEQ ID NO:39, b is an integer of 15 to 1908, where both a and b correspond to the positions of nucleotide residues shown in SEQ ID NO:39, and where the b is greater than or equal to a+14.

Features of Protein Encoded by Gene No: 30

In specific embodiments, polypeptides of the invention comprise the following amino acid sequence: MKIS-FVDLPKSIVVTRPSQNLLSSFTVQPCV-LGPQPNSIVPHF TFHGQLPSLLDIKPHILNXVEI (SEQ ID NO:645). Polynucleotides encoding these polypeptides are also encompassed by the invention.

This gene is expressed primarily in meningial and to a lesser extent in breast and adult brain.

Therefore, polynucleotides and polypeptides of the invention are useful as reagents for differential identification of the tissue(s) or cell type(s) present in a biological sample and for diagnosis of diseases and conditions: neural disorders, particularly diseases of the meningea and related brain diseases. Similarly, polypeptides and antibodies directed to these polypeptides are useful in providing immunological probes for differential identification of the tissue(s) or cell type(s). For a number of disorders of the above tissues or cells, particularly of the meningea and related brain diseases, expression of this gene at significantly higher or lower levels may be routinely detected in certain tissues and cell types (e.g., miningea, mammary tissue, and brain and other tissue of the nervous system, and cancerous and wounded tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in meningial tissue suggests that the protein product of this clone would be useful for the detection/treatment of neurodegenerative disease states, behavioural disorders, or inflammatory conditions such as Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, panic disorder, learning disabilities, ALS, psychoses, autism, and altered bahaviors, including disorders in feeding, sleep patterns, balance, and preception. In addition, the gene or gene product may also play a role in the treatment and/or detection of developmental disorders associated with the developing embryo, sexually-linked disorders, or disorders of the cardiovascular system. Protein, as well as, antibodies directed against the protein may show utility as a tumor marker and/or immunotherapy targets for the above listed tissues.

Preferred epitopes include those comprising a sequence shown in SEQ ID NO.349 as residues: Ser-19 to Glu-26.

Many polynucleotide sequences, such as EST sequences, are publicly available and accessible through sequence databases. Some of these sequences are related to SEQ ID NO:40 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 444 of SEQ ID NO:40, b is an integer of 15 to 458, where both a and b correspond to the positions of nucleotide residues shown in SEQ ID NO:40, and where the b is greater than or equal to a+14.

Features of Protein Encoded by Gene No: 31

The gene encoding the disclosed cDNA is believed to reside on chromosome 12. Accordingly, polynucleotides related to this invention are useful as a marker in linkage analysis for chromosome 12.

This gene is expressed in meningea, fetal spleen, osteoblast and to a lesser extent in activated T-cells, endometrial stromal cells, fetal lung, HL-60, thymus, testis and endothelial cells.

Therefore, polynucleotides and polypeptides of the invention are useful as reagents for differential identification of the tissue(s) or cell type(s) present in a biological sample and for diagnosis of diseases and conditions: meningeal disease, osteoporosis, immune diseases, and hematoplastic diseases. Similarly, polypeptides and antibodies directed to these polypeptides are useful in providing immunological probes for identification of the tissue(s) or cell type(s). For a number of disorders of the above tissues or cells, particularly of the meningeal diseases, osteoporosis, immune diseases, and hematoplastic diseases, expression of this gene at significantly higher or lower levels may be routinely detected in certain tissues and cell types (e.g., blood cells, endometrium, lung, thymus, testis, and endothelial cells, and cancerous and wounded tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution to this gene indicates that polynucleotides and polypeptides corresponding to this gene are useful for the diagnosis and treatment of meningeal, osteoporosis, immune diseases, hematoplastic diseases, reproductive or pulmonary disorders. Protein, as well as, antibodies directed against the protein may show utility as a tumor marker and/or immunotherapy targets for the above listed tissues.

Preferred epitopes include those comprising a sequence shown in SEQ ID NO.350 as residues: Gln-7 to Arg-12, Pro-69 to Glu-76, Leu-119 to Trp-125.

Many polynucleotide sequences, such as EST sequences, are publicly available and accessible through sequence databases. Some of these sequences are related to SEQ ID NO:41 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1139 of SEQ ID NO:41, b is an integer of 15 to 1153, where both a and b correspond to the positions of nucleotide residues shown in SEQ ID NO:41, and where the b is greater than or equal to a+14.

Features of Protein Encoded by Gene No: 32

The translation product of this gene was shown to have homology to the bovine leucine aminopeptidase (LAP), which is thought to be involved in the intracellular degradation and turn-over of cellular proteins (See Genbank Accession No. bbs|1137417). In specific embodiments, polypeptides of the invention comprise the following amino acid sequence: PQFTSAGENF (SEQ ID NO:646), LKAGKTRTFYGL (SEQ ID NO:647), AGIDEQEN-WHEGKENIRAAVAAGCRQIQDLE (SEQ ID NO:648), SVEVDPCGDAQ (SEQ ID NO:649), EPPLVFVGKGIT-FDSGGISIKA (SEQ ID NO:650), ANMDLMRAD MGGAATICSAIVSAAKL (SEQ ID NO:651), GLA-PLCENMPSGKANKPGDVVRA (SEQ ID NO:652), NGK-TIQVDNTDAEGRLILADALCYAHTFNPK (SEQ ID NO:653), ALGSGATGVFTNSSWLWNKLFEASIET-GDRVWRMPLFEHYTRQV (SEQ ID NO:654), VNNIGKYRSAGACTAAAFLKEFVTHPK-WAHLDIAGVMTNKDEVPYLRKGM AAAEGAVLGLY-EYDDLKQK (SEQ ID NO:655), or DMTKGLV-LGIYSKEKE (SEQ ID NO: 656). Polynucleotides encoding these polypeptides are also encompassed by the invention.

This gene is expressed primarily in human thymus and to a much lesser extent in infant brain, T-cells, smooth muscle, endothelial cells, bone marrow, human ovarian tumor and keratinocytes testes, osteoclastoma, breast, and tonsils.

Therefore, polynucleotides and polypeptides of the invention are useful as reagents for differential identification of the tissue(s) or cell type(s) present in a biological sample and for diagnosis of diseases and conditions: Diseases involving the thymus, particularly thymic cancer and diseases involving T-cell maturation. Similarly, polypeptides and antibodies directed to these polypeptides are useful in providing immunological probes for differential identification of the tissue(s) or cell type(s). For a number of disorders of the above tissues or cells, particularly of the thymus, expression of this gene at significantly higher or lower levels may be routinely detected in certain tissues and cell types (e.g., thymus, brain, and other tissue of the nervous system, blood cells, bone marrow, ovaries, and testes, and other reproductive tissue, mammary tissue, tonsils, melanocytes and cancerous and wounded tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in thymus and immune tissues, combined with the homology to the LAP gene indicate that polynucleotides and polypeptides corresponding to this gene are useful for diagnosis and treatment of diseases of the thymus particularly thymic cancer and diseases involving T-cell maturation. Protein, as well as, antibodies directed against the protein may show utility as a tumor marker and/or immunotherapy targets for the above listed tissues.

Preferred epitopes include those comprising a sequence shown in SEQ ID NO.351 as residues: Ser-42 to Val-49, Lys-79 to Thr-85, Asp-109 to Asn-120, Asp-163 to Lys-170, Tyr-178 to Trp-186, Pro-206 to Pro-212, His-265 to Glu-274, Met-338 to Gly-347, Asp-361 to Glu-366.

Many polynucleotide sequences, such as EST sequences, are publicly available and accessible through sequence databases. Some of these sequences are related to SEQ ID NO:42 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1969 of SEQ ID NO:42, b is an integer of 15 to 1983, where both a and b correspond to the positions of nucleotide residues shown in SEQ ID NO:42, and where the b is greater than or equal to a+14.

Features of Protein Encoded by Gene No: 33

This gene is expressed primarily in human tonsils, and placenta, and to a lesser extent in adipocytes, melanocyte, and infant brain.

Therefore, polynucleotides and polypeptides of the invention are useful as reagents for differential identification of the tissue(s) or cell type(s) present in a biological sample and for diagnosis of diseases and conditions: inflammatory diseases, immune diseases, and metabolic disorders, particularly obesity. Similarly, polypeptides and antibodies directed to these polypeptides are useful in providing immunological probes for differential identification of the tissue(s) or cell type(s). For a number of disorders of the above tissues or cells, particularly of the inflammatory diseases, immune diseases, and obesity, expression of this gene at significantly higher or lower levels may be routinely detected in certain tissues and cell types (e.g.,metabolic tissue, tonsils, placenta, adipocytes, melanocytes, and brain and other tissue of the nervous system, and cancerous and wounded tissues) or bodily fluids (e.g.lymph, bile, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to this gene indicate that polynucleotides and polypeptides corresponding to this gene are useful for diagnosis and treatment of diseases such as inflammation, immune diseases, and obesity. Protein, as well as, antibodies directed against the protein may show utility as a tumor marker and/or immunotherapy targets for the above listed tissues.

Preferred epitopes include those comprising a sequence shown in SEQ ID NO.352 as residues: Ser-26 to Ser-34.

Many polynucleotide sequences, such as EST sequences, are publicly available and accessible through sequence databases. Some of these sequences are related to SEQ ID NO:43 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1392 of SEQ ID NO:43, b is an integer of 15 to 1406, where both a and b correspond to the positions of nucleotide residues shown in SEQ ID NO:43, and where the b is greater than or equal to a+14.

Features of Protein Encoded by Gene No: 34

The translation product of this gene was found to have homology to the human FGF-1 intracellular binding protein which is thought to play a role in the regulation of fibroblast growth factors (See Genbank Accession No. gi|2738520 (AF010187)). In specific embodiments, polypeptides of the invention comprise the following amino acid sequence: MTSELDIFVGNTILIDEDVYRLWLDGYS-VTDAVALRVRSGILEQTG ATAAVLQSDTMDHY (SEQ ID NO:657), RTFHMLERLLHAPPKLLHQLWFQIPPSR QALLIERYYAFDEAFVREVLGKKLSKGTKKDL (SEQ ID NO:658), DDISTKTGITLK SCRRQFDN-FKRVFKVVEEMRGSLVDNIQQHFLLS-DRLARDYAAWFFA (SEQ ID NO:659), NNRFET-GKKKLQYLSFGDFAFCAELMIQNWTLG (SEQ ID NO:660), AAKLTHNKDVRDLFVDLV (SEQ ID NO:661), EKFVEPCRSDHWPLSDVRFFLNQ YSASV (SEQ ID NO:662), SLDGFRHQA (SEQ ID NO:663), RPPTLTIKLL (SEQ ID NO:664), IMThVPPN (SEQ ID NO:665), or ISIQRLSNPSMASDTRPSGTATWAPS AAASCACI-MTEVPPNVRPR (SEQ ID NO:666). Polynucleotides encoding these polypeptides are also encompassed by the invention. When tested against Jurkat T-cell cell lines, supernatants removed from cells containing this gene activated the GAS (gamma activation site) promoter element. Thus, it is likely that this gene activates T-cells through the Jaks-STAT signal transduction pathway. GAS is a promoter element found upstream in many genes which are involved in the Jaks-STAT pathway. The Jaks-STAT pathway is a large, signal transduction pathway involved in the differentiation and proliferation of cells. Therefore, activation of the Jaks-STATs pathway, reflected by the binding of the GAS element, can be used to indicate proteins involved in the proliferation and differentiation of cells. The gene encoding the disclosed cDNA is believed to reside on chromosome 11. Accordingly, polynucleotides related to this invention are useful as a marker in linkage analysis for chromosome 11.

This gene is expressed in activated T cells, and to a lesser extent in pituitary, testis, and b lymph node.

Therefore, polynucleotides and polypeptides of the invention are useful as reagents for differential identification of the tissue(s) or cell type(s) present in a biological sample and for diagnosis of diseases and conditions: immune disorders, particularly diseases relating to T-cells. Similarly, polypeptides and antibodies directed to these polypeptides are useful in providing immunological probes for differential identification of the tissue(s) or cell type(s). For a number of disorders of the above tissues or cells, particularly of the disorders of the immune system, expression of this gene at significantly higher or lower levels may be routinely detected in certain tissues and cell types (e.g.immune, hematopoietic, pituitary, testes and other reproductive tissue, mammary tissue, and lymphoid tissue, and cancerous and wounded tissues) or bodily fluids (e.g.lymph, seminal fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in T-cells and lymph nodes, combined with its homology to a known regulatory protein for FGF-1, and the detected GAS activity in T-cells, strongly suggests that the protein product of this clone would be useful for the diagnosis and treatment of a variety of immune system disorders. Specifically, the expression of this gene product in T-cells suggests a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersentivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Preferred epitopes include those comprising a sequence shown in SEQ ID NO.353 as residues: Lys-111 to Thr-125, Ser-133 to Lys-142, Asn-182 to Lys-190, Asp-216 to Asp-221, Asp-227 to Thr-233.

Many polynucleotide sequences, such as EST sequences, are publicly available and accessible through sequence databases. Some of these sequences are related to SEQ ID NO:44 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1377 of SEQ ID NO:44, b is an integer of 15 to 1391, where both a and b correspond to the positions of nucleotide residues shown in SEQ ID NO:44, and where the b is greater than or equal to a+14.

Features of Protein Encoded by Gene No: 35

This gene is expressed primarily in infant brain.

Therefore, polynucleotides and polypeptides of the invention are useful as reagents for differential identification of the tissue(s) or cell type(s) present in a biological sample and for diagnosis of diseases and conditions: neural disorders, particularly neurodegenerative or behavioral disorders. Similarly, polypeptides and antibodies directed to these polypeptides are useful in providing immunological probes for differential identification of the tissue(s) or cell type(s). For a number of disorders of the above tissues or cells, particularly of the diseases relating to neurological disorders, expression of this gene at significantly higher or lower levels may be routinely detected in certain tissues and cell types (e.g., brain, and other tissue of the nervous system, and cancerous and wounded tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in infant brain suggests that the protein product of this clone would be useful for the detection/treatment of neurodegenerative disease states, behavioural disorders, or inflammatory conditions such as Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischernia and infarction, aneurysms, hemorrhages, schizophrenia, mania, dementia, paranoia, obsessive compulsive disorder, panic disorder, learning disabilities, ALS, psychoses , autism, and altered bahaviors, including disorders in feeding, sleep patterns, balance, and preception. In addition, the gene or gene product may also play a role in the treatment and/or detection of developmental disorders associated with the developing embryo, sexually-linked disorders, or disorders of the cardiovascular system. Protein, as well as, antibodies directed against the protein may show utility as a tumor marker and/or immunotherapy targets for the above listed tissues.

Preferred epitopes include those comprising a sequence shown in SEQ ID NO.354 as residues: Ser-67 to Glu-74, Ala-117 to Leu-126, Gln-128 to Arg-137, Lys-158 to Gly-167.

Many polynucleotide sequences, such as EST sequences, are publicly available and accessible through sequence databases. Some of these sequences are related to SEQ ID NO:45 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1555 of SEQ ID NO:45, b is an integer of 15 to 1569, where both a and b correspond to the positions of nucleotide residues shown in SEQ ID NO:45, and where the b is greater than or equal to a+14.

Features of Protein Encoded by Gene No: 36

This gene is expressed primarily in infant brain.

Therefore, polynucleotides and polypeptides of the invention are useful as reagents for differential identification of the tissue(s) or cell type(s) present in a biological sample and for diagnosis of diseases and conditions: neurological disorders. Similarly, polypeptides and antibodies directed to these polypeptides are useful in providing immunological probes for differential identification of the tissue(s) or cell type(s). For a number of disorders of the above tissues or cells, particularly of the diseases relating to neurological disorders, expression of this gene at significantly higher or lower levels may be routinely detected in certain tissues and cell types (e.g., brain and other tissue of the nervous system, and cancerous and wounded tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in brain suggests that the protein product of this clone would be useful for the detection/treatment of neurodegenerative disease states, behavioural disorders, or inflammatory conditions such as Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, panic disorder, learning disabilities, ALS, psychoses , autism, and altered bahaviors, including disorders in feeding, sleep patterns, balance, and preception. In addition, the gene or gene product may also play a role in the treatment and/or detection of developmental disorders associated with the developing embryo, sexually-linked disorders, or disorders of the cardiovascular system. Alternatively, expression within fetal tissue and other cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:46 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1910 of SEQ ID NO:46, b is an integer of 15 to 1924, where both a and b correspond to the positions of nucleotide residues shown in SEQ ID NO:46, and where the b is greater than or equal to a+14.

Features of Protein Encoded by Gene No: 37

Polynucleotides of the invention do not comprise the nucleic acid sequence shown as Genbank accession no. gb|G221951|G22195, which is hereby incorporated herein by reference. The gene encoding the disclosed cDNA is believed to reside on chromosome 10. Accordingly, polynucleotides related to this invention are useful as a marker in linkage analysis for chromosome 10.

This gene is expressed primarily in human ovary.

Therefore, polynucleotides and polypeptides of the invention are useful as reagents for differential identification of the tissue(s) or cell type(s) present in a biological sample and for diagnosis of diseases and conditions: ovarian cancer.

Similarly, polypeptides and antibodies directed to these polypeptides are useful in providing immunological probes for differential identification of the tissue(s) or cell type(s). For a number of disorders of the above tissues or cells, particularly of the ovarian disorders such as those involving germ cells, ovarian follicles, stromal cells, expression of this gene at significantly higher or lower levels may be routinely detected in certain tissues and cell types (e.g., ovary and other reproductive tissue, and cancerous and wounded tissues) or bodily fluids (e.g.lymph, amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for the diagnosis, treatment, and/or prevention of a variety of reproductive or endocrine disorders, particularly ovariopathies, tumors, or dysfunctions. Protein, as well as, ' antibodies directed against the protein may show utility as a tumor marker and/or immunotherapy targets for the above listed tissues.

Preferred epitopes include those comprising a sequence shown in SEQ ID NO.356 as residues: Met-1 to Gly-17, Glu-49 to Ile-54.

Many polynucleotide sequences, such as EST sequences, are publicly available and accessible through sequence databases. Some of these sequences are related to SEQ ID NO:47 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 461 of SEQ ID NO:47, b is an integer of 15 to 475, where both a and b correspond to the positions of nucleotide residues shown in SEQ ID NO:47, and where the b is greater than or equal to a+14.

Features of Protein Encoded by Gene No: 38

This gene is expressed primarily in lymph node breast cancer.

Therefore, polynucleotides and polypeptides of the invention are useful as reagents for differential identification of the tissue(s) or cell type(s) present in a biological sample and for diagnosis of diseases and conditions: immune or reproductive disorders, particularly breast cancer. Similarly, polypeptides and antibodies directed to these polypeptides are useful in providing immunological probes for differential identification of the tissue(s) or cell type(s). For a number of disorders of the above tissues or cells, particularly of the breast cancer, expression of this gene at significantly higher or lower levels may be routinely detected in certain tissues and cell types (e.g., mammary tissue and lymphoid tissue, and cancerous and wounded tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for use as a diagnostic marker for breast cancer. Protein, as well as, antibodies directed against the protein may show utility as a tumor marker and/or immunotherapy targets for the above listed tissues.

Preferred epitopes include those comprising a sequence shown in SEQ ID NO.357 as residues: Leu-16 to Asp-24.

Many polynucleotide sequences, such as EST sequences, are publicly available and accessible through sequence databases. Some of these sequences are related to SEQ ID NO:48 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 332 of SEQ ID NO:48, b is an integer of 15 to 346, where both a and b correspond to the positions of nucleotide residues shown in SEQ ID NO:48, and where the b is greater than or equal to a+14.

Features of Protein Encoded by Gene No: 39

The translation product of this gene was shown to have homology to the type III adenylyl cyclase of Rattus norvegicus (See Genbank Accession No gi|202715.), which is thought to play an essential role in mediating signal transduction in the sensory neuronal cilia of olfactory neurons. In specific embodiments, polypeptides of the invention comprise the following amino acid sequence: ERWQHLAD-LADFALAMKDTLTNINNQSFNN (SEQ ID NO:667), or HFLHGPLAQEDKSERERWQHLADLAD-FALAMKDTLTNIN NQSFNNXHCA (SEQ ID NO:668). Polynucleotides encoding these polypeptides are also encompassed by the invention.

This gene is expressed primarily in brain, and to a lesser extent in other tissues.

Therefore, polynucleotides and polypeptides of the invention are useful as reagents for differential identification of the tissue(s) or cell type(s) present in a biological sample and for diagnosis of diseases and conditions: neuronal disorders such as trauma, brain degeneration, and brain tumor. Similarly, polypeptides and antibodies directed to these polypeptides are useful in providing immunological probes for differential identification of the tissue(s) or cell type(s). For a number of disorders of the above tissues or cells, particularly of the brain, expression of this gene at significantly higher or lower levels may be routinely detected in certain tissues and cell types (e.g., brain and other tissue of the nervous system, and cancerous and wounded tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in brain suggests that the protein product of this clone would be useful for the detection/treatment of neurodegenerative disease states, behavioural disorders, or inflammatory conditions such as Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, panic disorder, learning disabilities, ALS, psychoses, autism, and altered bahaviors, including disorders in feeding, sleep patterns, balance, and preception. In addition, the gene or gene product may also play a role in the treatment and/or detection of developmental disorders associated with the developing embryo, sexually-linked disorders, or disorders of the cardiovascular system. Protein, as well as, antibodies directed against the protein may show utility as a tumor marker and/or immunotherapy targets for the above listed tissues.

Preferred epitopes include those comprising a sequence shown in SEQ ID NO.358 as residues: Gln-19 to Phe-25.

Many polynucleotide sequences, such as EST sequences, are publicly available and accessible through sequence databases. Some of these sequences are related to SEQ ID NO:49 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1352 of SEQ ID NO:49, b is an integer of 15 to 1366, where both a and b correspond to the positions of nucleotide residues shown in SEQ ID NO:49, and where the b is greater than or equal to a+14.

Features of Protein Encoded by Gene No: 40

Polynucleotides of the invention do not comprise the nucleic acid sequence shown as Genbank accession no. gb|AB006624|AB006624, which is hereby incorporated herein by reference.

This gene is expressed in early stage human embryo, adrenal gland tumor, and immune tissues such as fetal liver, fetal spleen, T-cell, and myeloid progenitor cell line and to a lesser extent in ovary, colon cancer, and a few other tissues.

Therefore, polynucleotides and polypeptides of the invention are useful as reagents for differential identification of the tissue(s) or cell type(s) present in a biological sample and for diagnosis of diseases and conditions: tumorigenesis including adrenal gland tumor, colon cancer and various other tumors, developmental and immune disorders. Similarly, polypeptides and antibodies directed to these polypeptides are useful in providing immunological probes for differential identification of the tissue(s) or cell type(s). For a number of disorders of the above tissues or cells, particularly of the cancer tissues, early stage human tissues, and immune system, expression of this gene at significantly higher or lower levels may be routinely detected in certain tissues and cell types (e.g., liver, spleen, blood cells, developmental, bone marrow, ovary and other reproductive tissue, and colon, and cancerous and wounded tissues) or bodily fluids (e.g.lymph, amniotic fluid, bile, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in fetal tissues and other cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Alternatively, the tissue distribution in myeloid progenitor cells, in addition to fetal spleen, suggests that the protein product of this clone would be useful for the treatment and diagnosis of hematopoetic related disorders such as anemia, pancytopenia, leukopenia, thrombocytopenia or leukemia since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:50 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1391 of SEQ ID NO:50, b is an integer of 15 to 1405, where both a and b correspond to the positions of nucleotide residues shown in SEQ ID NO:50, and where the b is greater than or equal to a+14.

Features of Protein Encoded by Gene No: 41

This gene is expressed primarily in fetal lung, endothelial cells, liver, thymus and a few other immune tissues.

Therefore, polynucleotides and polypeptides of the invention are useful as reagents for differential identification of the tissue(s) or cell type(s) present in a biological sample and for diagnosis of diseases and conditions: immune disorders such as immune deficiency and autoimmune diseases, pulmonary diseases, liver diseases,developmental disorders, and tumor metastasis. Similarly, polypeptides and antibodies directed to these polypeptides are useful in providing immunological probes for differential identification of the tissue(s) or cell type(s). For a number of disorders of the above tissues or cells, particularly of the fetal lung, liver, endothelial cells, and immune tissues, expression of this gene at significantly higher or lower levels may be routinely detected in certain tissues and cell types (e.g., lung, endothelial cells, liver, thymus, and other tissue of the immune system, and cancerous and wounded tissues) or bodily fluids (e.g.lymph, amniotic fluid, pulmonary surfactant, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for diagnosis of immune disorders and pulmonary and hepatic diseases. Its promoter may also be used for immune system and lung-specific gene therapies. The expression of this gene in endothelial cells indicates that it may also involve in angiogenesis which therefore may play role in tumor metastasis. Similarly, expression within fetal tissue and other cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:51 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2619 of SEQ ID NO:5 1, b is an integer of 15 to 2633, where both a and b correspond to the positions of nucleotide residues shown in SEQ ID NO:51, and where the b is greater than or equal to a+14.

Features of Protein Encoded by Gene No: 42

This gene is expressed primarily in liver, thyroid, parathyroid and to a lesser extent in fetal lung, stomach and early embryos.

Therefore, polynucleotides and polypeptides of the invention are useful as reagents for differential identification of the tissue(s) or cell type(s) present in a biological sample and for diagnosis of diseases and conditions: metabolic regulation, obesity, heptic failure, heptacellular tumors, endocrine disorders, particularly thyroiditis and thyroid tumors. Similarly, polypeptides and antibodies directed to these polypeptides are useful in providing immunological probes for differential identification of the tissue(s) or cell type(s). For a number of disorders of the above tissues or cells, particularly of the digestive/endocrine system expression of this gene at significantly higher or lower levels may be routinely detected in certain tissues and cell types (e.g., liver, thyroid, parathyroid, lung, stomach, and embryonic tissue, and cancerous and wounded tissues) or bodily fluids (e.g.lymph, bile, amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and the extracellular locations indicates that polynucleotides and polypeptides corresponding to this gene are useful for the detection and treatment of digestive/endocrine disorders, including metabolic regulation, heptic failure, malabsortion, gastritis and neoplasms. Similarly, expression within thyroid and parathyroid tissues suggests that the protein product of this clone would be useful for the detection, treatment, and/or prevention of various endocrine disorders and cancers, particularly Addison's disease, Cushing's Syndrome, and disorders and/or cancers of the pancrease (e.g. diabetes mellitus), adrenal cortex, ovaries, pituitary (e.g., hyper-, hypopituitarism), thyroid (e.g. hyper-, hypothyroidism), parathyroid (e.g. hyper-,hypoparathyroidism) , hypothallamus, and testes. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:52 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 763 of SEQ ID NO:52, b is an integer of 15 to 777, where both a and b correspond to the positions of nucleotide residues shown in SEQ ID NO:52, and where the b is greater than or equal to a+14.

Features of Protein Encoded by Gene No: 43

The gene encoding the disclosed cDNA is believed to reside on chromosome 3. Accordingly, polynucleotides related to this invention are useful as a marker in linkage analysis for chromosome 3.

This gene is expressed primarily in Schizophrenic adult brain, pituitary, front cortex, hypothalmus and to a lesser extent in retina, adipose and stomach cancer and placenta.

Therefore, polynucleotides and polypeptides of the invention are useful as reagents for differential identification of the tissue(s) or cell type(s) present in a biological sample and for diagnosis of diseases and conditions: schizophrenia and other neurological disorders. Similarly, polypeptides and antibodies directed to these polypeptides are useful in providing immunological probes for differential identification of the tissue(s) or cell type(s). For a number of disorders of the above tissues or cells, particularly of the central nervous system, expression of this gene at significantly higher or lower levels may be routinely detected in certain tissues and cell types (e.g.neural, retinal tissue, adipose, stomach, and placenta, and cancerous and wounded tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful in treatment/detection of disorders in the nerve system, including schizophrenia, neurodegeneration, and neoplasia. Additionally, a secreted protein in brain may serve as an endocrine. Similarly, the secreted protein may also be used to determine biological activity, to raise antibodies, as tissue markers, to isolate cognate ligands or receptors, to identify agents that modulate their interactions and as nutritional supplements. It may also have a very wide range of biological acitivities. Typical of these are cytokine, cell proliferation/differentiation modulating activity or induction of other cytokines; immunostimulating/immunosuppressant activities (e.g.for treating human immunodeficiency virus infection, cancer, autoimmune diseases and allergy); regulation of hematopoiesis (e.g. for treating anaemia or as adjunct to chemotherapy); stimulation or growth of bone, cartilage, tendons, ligaments and/or nerves (e.g. for treating wounds, stimulation of follicle stimulating hormone (for control of fertility); chemotactic and chemokinetic activities (e.g. for treating infections, tumors); hemostatic or thrombolytic activity (e.g. for treating haemophilia, cardiac infarction etc.); anti-inflammatory activity (e.g. for treating septic shock, Crohn's disease); as antimicrobials; for treating psoriasis or other hyperproliferative diseases; for regulation of metabolism, and behaviour. Also contemplated is the use of the corresponding nucleic acid in gene therapy procedures. Protein, as well as, antibodies directed against the protein may show utility as a tumor marker and/or immunotherapy targets for the above listed tissues.

Preferred epitopes include those comprising a sequence shown in SEQ ID NO.362 as residues: Pro-14 to Ser-23, Ser-57 to Phe-65, Asn-121 to Asn-131.

Many polynucleotide sequences, such as EST sequences, are publicly available and accessible through sequence databases. Some of these sequences are related to SEQ ID NO:53 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 588 of SEQ ID NO:53, b is an integer of 15 to 602, where both a and b correspond to the positions of nucleotide residues shown in SEQ ID NO:53, and where the b is greater than or equal to a+14.

Features of Protein Encoded by Gene No: 44

The translation product of this gene shares sequence homology with a human GTP binding protein which are thought to be important in signal transduction and protein transport (See Genbank Accession No. dbj∥D84488_1). In specific embodiments, polypeptides of the invention comprise the following amino acid sequence: MGSRDHLFKVLVVGDAAVGKTSLVQDYS- QDSFSKHYKSTVGVDFALKVLQ WSDYEIVRLQ (SEQ ID NO:669), LWDIAGQERFFSMTRLYYR- DASACVIMFD VTNATTFSNSQRWKQDLDSKLTLP- NGEPVPC (SEQ ID NO:670), LLANKCD LSPWAVSRD- QIDRFSKENGFTGWTETSVKENKNINEAMRVLIEK MMRNSTED (SEQ ID NO:671), or IMSLSTQGDYIN- LQTK (SEQ ID NO:672). Polynucleotides encoding these polypeptides are also encompassed by the invention.

This gene is expressed primarily in umbilical vein and microvascular endothelial cells, GM-CSF treated macrophage, anergic T cells, osteoblast, osteoclast, CD34+ cells and to a lesser extent in gall bladder.

Therefore, polynucleotides and polypeptides of the invention are useful as reagents for differential identification of the tissue(s) or cell type(s) present in a biological sample and for diagnosis of diseases and conditions: bone formation and growth, osteonecrosis, osteoporosis, angiogenesis and/or hematopoeisis. Similarly, polypeptides and antibodies directed to these polypeptides are useful in providing immunological probes for differential identification of the tissue(s) or cell type(s). For a number of disorders of the above tissues or cells, particularly of the skeletal and hematopoeisis systems, expression of this gene at significantly higher or lower levels may be routinely detected in certain tissues and cell types (e.g., endothelial cells, blood cells, bone, and gall bladder, and cancerous and wounded tissues) or bodily fluids (e.g.lymph, amniotic fluid, bile, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in various immune tissues and cell types combined with its homology to a conserved GTP binding protein indicates that polynucleotides and polypeptides corresponding to this gene are useful for treatment/detection of bone formation and growth, osteonecrosis, osteoporosis, and/or hematopoeisis because its involvement in the growth signaling or angiogenesis. Protein, as well as, antibodies directed against the protein may show utility as a tumor marker and/or immunotherapy targets for the above listed tissues.

Preferred epitopes include those comprising a sequence shown in SEQ ID NO.363 as residues: Asp-26 to Ser-38, Leu-76 to Ala-81, Ser-97 to Ser-108, Asp-137 to Phe-148, Thr-154 to Ile-162, Gln-194 to Ser-199.

Many polynucleotide sequences, such as EST sequences, are publicly available and accessible through sequence databases. Some of these sequences are related to SEQ ID NO:54 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1735 of SEQ ID NO:54, b is an integer of 15 to 1749, where both a and b correspond to the positions of nucleotide residues shown in SEQ ID NO:54, and where the b is greater than or equal to a+14.

Features of Protein Encoded by Gene No: 45

The translation product of this gene shares sequence homology with a signal sequence receptor gamma subunit which is thought to be important in protein translocation on the endoplasmic reticulum.

This gene is expressed primarily in adrenal gland, salivary gland, prostate, and to a lesser extent in endothelial cells and smooth muscle.

Therefore, polynucleotides and polypeptides of the invention are useful as reagents for differential identification of the tissue(s) or cell type(s) present in a biological sample and for diagnosis of diseases and conditions: endocrine or gastrointestinal disorders, particularly disorders in protein secretion. Similarly, polypeptides and antibodies directed to these polypeptides are useful in providing immunological probes for differential identification of the tissue(s) or cell type(s). For a number of disorders of the above tissues or cells, particularly of the secretory organs, expression of this gene at significantly higher or lower levels may be routinely detected in certain tissues and cell types (e.g., adrenal gland, salivary gland, prostate, endothelial cells, and smooth muscle, and cancerous and wounded tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in various endocrine tissues and homology to SSR gamma subunit indicate that polynucleotides and polypeptides corresponding to this gene are useful for endocrine disorders, prostate cancer, xerostomia or sialorrhea. Protein, as well as, antibodies directed against the protein may show utility as a tumor marker and/or immunotherapy targets for the above listed tissues.

Preferred epitopes include those comprising a sequence shown in SEQ ID NO.364 as residues: Lys-27 to Ser-32.

Many polynucleotide sequences, such as EST sequences, are publicly available and accessible through sequence databases. Some of these sequences are related to SEQ ID NO:55 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1882 of SEQ ID NO:55, b is an integer of 15 to 1896, where both a and b correspond to the positions of nucleotide residues shown in SEQ ID NO:55, and where the b is greater than or equal to a+14.

Features of Protein Encoded by Gene No: 46

The gene encoding the disclosed cDNA is believed to reside on chromosome 3. Accordingly, polynucleotides related to this invention are useful as a marker in linkage analysis for chromosome 3.

This gene is expressed primarily in osteoclastoma cells, and to a lesser extent in melanocyte, amygdala, brain, and stomach.

Therefore, polynucleotides and polypeptides of the invention are useful as reagents for differential identification of the tissue(s) or cell type(s) present in a biological sample and for diagnosis of diseases and conditions: skeletal disorders, particularly ossification, osteoporosis, fracture, osteonecrosis, osteosarcoma. Similarly, polypeptides and antibodies directed to these polypeptides are useful in providing immunological probes for differential identification of the tissue(s) or cell type(s). For a number of disorders of the above tissues or cells, particularly of the skeletal systems, expression of this gene at significantly higher or lower levels may be routinely detected in certain tissues and cell types (e.g.skeletal, melanocytes, amygdala, brain and other tissue of the nervous system, and stomach, and cancerous and wounded tissues) or bodily fluids (e.g.lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in osteoclastoma cells suggests that the protein product of this clone may play a role in the detection and treatment of disorders and conditions affecting the skeletal system, in particular osteoporosis as well as disorders afflicting connective tissues (e.g. arthritis, trauma, tendonitis, chrondomalacia and inflammation), such as in the diagnosis or treatment of various autoimmune disorders such as rheumatoid arthritis, lupus, scleroderma, and dermatomyositis as well as dwarfism, spinal deformation, and specific joint abnormalities as well as chondrodysplasias (ie. spondyloepiphyseal dysplasia congenita, familial osteoarthritis, Atelosteogenesis type II, metaphyseal chondrodysplasia type Schmid). Protein, as well as, antibodies directed against the protein may show utility as a tumor marker and/or immunotherapy targets for the above listed tissues indicates that polynucleotides and polypeptides corresponding to this gene are useful in intervention of ossification, osteoporosis, fracture, osteonecrosis and osteosarcoma.

Preferred epitopes include those comprising a sequence shown in SEQ ID NO.365 as residues: Gln-19 to Tyr-27, Pro-47 to Glu-59.

Many polynucleotide sequences, such as EST sequences, are publicly available and accessible through sequence databases. Some of these sequences are related to SEQ ID NO:56 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1739 of SEQ ID NO:56, b is an integer of 15 to 1753, where both a and b correspond to the positions of nucleotide residues shown in SEQ ID NO:56, and where the b is greater than or equal to a+14.

Features of Protein Encoded by Gene No: 48

It is likely that the open reading frame containing the predicted signal peptide continues in the 5' direction. Therefore, in specific embodiments, polypeptides of the invention comprise the following amino acid sequence: RACRHSIYSAWVTSVNITD CKPPSIS-GAAHQGPTAPGRMVRILANGEIVQD-DDPRVRTTTQPPRGSIPRQSFF NRGHGAPPGGPG-PRQQQAGARLGAAQSPFNDLNRQLVN (SEQ ID NO:673). Polynucleotides encoding these polypeptides are also encompassed by the invention. The gene encoding the disclosed cDNA is believed to reside on chromosome 10. Accordingly, polynucleotides related to this invention are useful as a marker in linkage analysis for chromosome 10.

The translation product of this gene shares sequence homology with proline rich proteins which is thought to be important in protein-protein interactions.

This gene is expressed primarily in brain.

Therefore, polynucleotides and polypeptides of the invention are useful as reagents for differential identification of the tissue(s) or cell type(s) present in a biological sample and for diagnosis of diseases and conditions: neurological and psychological disorders. Similarly, polypeptides and antibodies directed to these polypeptides are useful in providing immunological probes for differential identification of the tissue(s) or cell type(s). For a number of disorders of the above tissues or cells, particularly of the central nerve system and endocrine system, expression of this gene at significantly higher or lower levels may be routinely detected in certain tissues and cell types (e.g., brain and other tissue of the nervous system, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to proline-rich proteins indicate that polynucleotides and polypeptides corresponding to this gene are useful in intervention and detection of neurological diseases, including trauma, neoplasia, degenerative or metabolic conditions in the central nerve system. Additionally, the gene product may be a secreted by the brain as an endocrine. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:58 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1035 of SEQ ID NO:58, b is an integer of 15 to 1049, where both a and b correspond to the positions of nucleotide residues shown in SEQ ID NO:58, and where the b is greater than or equal to a+14.

Features of Protein Encoded by Gene No: 49

The translation product of this gene shares sequence homology with the AOCB gene from Aspergillus nidulans which is important in asexual development. The gene encoding the disclosed cDNA is believed to reside on chromosome 12. Accordingly, polynucleotides related to this invention are useful as a marker in linkage analysis for chromosome 12.

This gene is expressed primarily in infant brain and to a lesser extent in the developing embryo, trachea tumors, B-cell lymphoma and synovial sarcoma.

Therefore, polynucleotides and polypeptides of the invention are useful as reagents for differential identification of the tissue(s) or cell type(s) present in a biological sample and for diagnosis of diseases and conditions: neurodegenerative diseases, leukemia and sarcoma's. Similarly, polypeptides and antibodies directed to these polypeptides are useful in providing immunological probes for differential identification of the tissue(s) or cell type(s). For a number of disorders of the above tissues or cells, particularly of the brain and immune system, expression of this gene at significantly higher or lower levels may be routinely detected in certain tissues and cell types (e.g., embryonic tissue, neural, blood cells, trachea, and synovial tissue, and cancerous and wounded tissues) or bodily fluids (e.g.amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in infant brain and sarcoma's and homology to a gene involved in a key step of eukaryotic development (fungal spore formation) indicates that the protein product of this clone could play a role in neurological diseases such as schizophrenia, particularly in infants. The existence of the gene in a B-cell lymphoma indicates the gene may be used in the treatment and detection of leukemia. Protein, as well as, antibodies directed against the protein may show utility as a tumor marker and/or immunotherapy targets for the above listed tissues.

Preferred epitopes include those comprising a sequence shown in SEQ ID NO.368 as residues: Thr-8 to Glu-13, Thr-89 to Leu-96, Ser-144 to Leu-152, Arg-160 to Asp-166.

Many polynucleotide sequences, such as EST sequences, are publicly available and accessible through sequence databases. Some of these sequences are related to SEQ ID NO:59 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1762 of SEQ ID NO:59, b is an integer of 15 to 1776, where both a and b correspond to the positions of nucleotide residues shown in SEQ ID NO:59, and where the b is greater than or equal to a+14.

Features of Protein Encoded by Gene No: 50

This gene is expressed primarily in fetal lung.

Therefore, polynucleotides and polypeptides of the invention are useful as reagents for differential identification of the tissue(s) or cell type(s) present in a biological sample and for diagnosis of diseases and conditions: pulmonary disorders including lung cancer. Similarly, polypeptides and antibodies directed to these polypeptides are useful in providing immunological probes for differential identification of the tissue(s) or cell type(s). For a number of disorders of the above tissues or cells, particularly of the pulmonary system, expression of this gene at significantly higher or lower levels may be routinely detected in certain tissues and cell types (e.g., lung, developing, and cancerous and wounded tissues) or bodily fluids (e.g.amniotic fluid, pulmonary surfactant, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution of this gene only in fetal lung indicates that it plays a key role in development of the pulmonary system. This would suggest that misregulation of the expression of this protein product in the adult could lead to lymphoma or sarcoma formation, particularly in the lung. It may also be involved in predisposition to certain pulmonary defects such as pulmonary edema and embolism, bronchitis and cystic fibrosis. Similarly, expression within fetal tissue and other cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:60 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 429 of SEQ ID NO:60, b is an integer of 15 to 443, where both a and b correspond to the positions of nucleotide residues shown in SEQ ID NO:60, and where the b is greater than or equal to a+14.

Features of Protein Encoded by Gene No: 51

The gene encoding the disclosed cDNA is believed to reside on chromosome 22. Accordingly, polynucleotides related to this invention are useful as a marker in linkage analysis for chromosome 22.

It has been discovered that this gene is expressed primarily in hematopoietic cell types and fetal cells and to a lesser extent in all tissue types.

Therefore, nucleic acids of the invention are useful as reagents for differential identification of the tissue(s) or cell type(s) present in a biological sample and for diagnosis of the following diseases and conditions: defects in the immune system and hematopoeisis. Similarly, polypeptides and antibodies directed to those polypeptides are useful to provide immunological probes for differential identification of the tissue(s) or cell type(s). For a number of disorders of the above tissues or cells, particularly of the immune and hematopoietic systems, expression of this gene at significantly higher or lower levels may be detected in certain tissues or cell types (e.g., cancerous and wounded tissues) or bodily fluids (e.g. lypmh, serum, plasma, urine, synovial fluid or spinal fluid) taken from an individual having such a disorder, relative to the standard gene expression level, i.e., the expression level in healthy tissue from an individual not having the disorder.

The tissue distribution of this gene predominantly in hematopoeitic cells and in the developing embryo suggests that the protein product of this clone would be useful for the detection and treatment of lymphomas and disease states affecting the immune system or hematopoeisis disorders. Expression of this gene product in hematopoeitic cells suggests a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immune deficiency diseases such as AIDS, leukemia, rheumatoid arthritis, inflammatory bowel disease, sepsis, acne, and psoriasis. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:61 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2874 of SEQ ID NO:61, b is an integer of 15 to 2888, where both a and b correspond to the positions of nucleotide residues shown in SEQ ID NO:61, and where the b is greater than or equal to a+14.

Features of Protein Encoded by Gene No: 52

It has been discovered that this gene is expressed primarily in prostate and to a lesser extent in fetal spleen, fetal liver, infant brain and T cell leukemias.

Therefore, nucleic acids of the invention are useful as reagents for differential identification of the tissue(s) or cell type(s) present in a biological sample and for diagnosis of the following diseases and conditions: prostate disorders, prostate cancer, leukemia. Similarly, polypeptides and antibodies directed to those polypeptides are useful to provide immunological probes for differential identification of the tissue(s) or cell type(s). For a number of disorders of the above tissues or cells, particularly of the immune system, and/or prostate gland expression of this gene at significantly higher or lower levels may be detected in certain tissues or cell types (e.g., cancerous and wounded tissues) or bodily fluids (e.g. lymph, serum, plasma, urine, synovial fluid or spinal fluid) taken from an individual having such a disorder, relative to the standard gene expression level, i.e., the expression level in healthy tissue from an individual not having the disorder.

The tissue distribution of this gene in prostate suggests that the protein product of this clone would be useful for detection or treatment of prostate disorders or prostate cancer. Its distribution in fetal liver and fetal spleen suggests it may play a role in the immune system. Expression of this gene product in hematopoietic cells suggests a role in the regulation of the proliferation; survival; differentiation; and/ or activation of potentially all hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immune deficiency diseases such as AIDS, leukemia, rheumatoid arthritis, inflammatory bowel disease, sepsis, acne, and psoriasis. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Preferred epitopes include those comprising a sequence shown in SEQ ID NO.371 as residues: Gln-70 to Asn-80, Leu-129 to Gly-150, Pro-153 to Thr-166, Met-174 to Val-181, Thr-185 to Ser-196, Pro-200 to Glu-216, Phe-225 to Ser-230, Ile-232 to Lys-253, Cys-257 to Pro-271, Leu-293 to Pro-298, Ile-339 to Asn-344.

Many polynucleotide sequences, such as EST sequences, are publicly available and accessible through sequence databases. Some of these sequences are related to SEQ ID NO:62 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1837 of SEQ ID NO:62, b is an integer of 15 to 1851, where both a and b correspond to the positions of nucleotide residues shown in SEQ ID NO:62, and where the b is greater than or equal to a+14.

Features of Protein Encoded by Gene No: 53

The translation product of this gene shares sequence homology with dynein.

It has been discovered that this gene is expressed primarily in brain.

Therefore, nucleic acids of the invention are useful as reagents for differential identification of the tissue(s) or cell type(s) present in a biological sample and for diagnosis of the following diseases and conditions: neuro-degenerative diseases of the brain. Similarly, polypeptides and antibodies directed to those polypeptides are useful to provide immunological probes for differential identification of the tissue(s) or cell type(s). For a number of disorders of the above tissues or cells, particularly neuro-degenerative diseases expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The predominant tissue distribution in the brain and homology to dynein, a microtubule motor protein involved in the positioning of cellular organelles and molecules suggests that the protein product of this clone would be useful for detection/treatment of neurodegenerative diseases, such as Alzheimers, Huntigtons, Parkinsons diseases and shizophrenia.

Preferred epitopes include those comprising a sequence shown in SEQ ID NO.372 as residues: Ser-89 to Thr-95.

Many polynucleotide sequences, such as EST sequences, are publicly available and accessible through sequence databases. Some of these sequences are related to SEQ ID NO:63 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 3528 of SEQ ID NO:63, b is an integer of 15 to 3542, where both a and b correspond to the positions of nucleotide residues shown in SEQ ID NO:63, and where the b is greater than or equal to a+14.

Features of Protein Encoded by Gene No: 54

The translation product of this gene shares sequence homology with ubiquitin-conjugation protein, an enzyme which is thought to be important in the procesing of the Huntingtons Disease causing gene.

It has been discovered that this gene is expressed primarily in brain and to a lesser extent in activated macrophages.

Therefore, nucleic acids of the invention are useful as reagents for differential identification of the tissue(s) or cell type(s) present in a biological sample and for diagnosis of the following diseases and conditions: neurodegenerative disease states including Huntingtons disease. Similarly, polypeptides and antibodies directed to those polypeptides are useful to provide immunological probes for differential identification of brain tissues. For a number of disorders of the above tissues or cells, particularly of the neurological systems expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The predominant tissue distribution of this gene in the brain and its homology to a Huntington interacting protein suggests that the protein product of this clone would be useful for the regulation of the expression of the Huntington disease gene and other neurodegenerative diseases including spinocerebullar ataxia types I and III, dentatorubropallidoluysian and spinal bulbar muscular atrophy. In addition, the existence of elevated levels of free ubiquitin pools in Alzehemiers disease, Parkinson's disease and amylotrophic lateral sclerosis indicates that the ubiquitin pathway of protein degradation plays a role in these disease states. Thus, considering the gene described here is homologous to a ubiquitin-conjugation protein it may play a general role in neurodegenerative conditions.

Preferred epitopes include those comprising a sequence shown in SEQ ID NO.373 as residues: Asn-19 to Arg-25, Arg-31 to Tyr-36, Glu-44 to Asp-52, Glu-57 to Gly-67, Leu-102 Lys-108, Ser-135 to Gly-141.

Many polynucleotide sequences, such as EST sequences, are publicly available and accessible through sequence databases. Some of these sequences are related to SEQ ID NO:64 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 869 of SEQ ID NO:64, b is an integer of 15 to 883, where both a and b correspond to the positions of nucleotide residues shown in SEQ ID NO:64, and where the b is greater than or equal to a+14.

Features of Protein Encoded by Gene No: 56

The gene encoding the disclosed cDNA is believed to reside on chromosome 9. Accordingly, polynucleotides related to this invention are useful as a marker in linkage analysis for chromosome 9.

It has been discovered that this gene is expressed primarily in T-cells (anergic T-cells, resting T-Cells, apoptotic T-cells) and lymph node (breast), as well as brain (hypothalamus, hippocampus, pituitary, infant brain, early-stage brain).

Therefore, nucleic acids of the invention are useful as reagents for differential identification of the tissue(s) or cell type(s) present in a biological sample and for diagnosis of the following diseases and conditions: immune (e.g. immunodeficiencies, autoimmunities, inflammation, leukemias & lymphomas) and neurological (e.g. Alzheimer's disease, dementia, schizophrenia) disorders. Similarly, polypeptides and antibodies directed to those polypeptides are useful to provide immunological probes for differential identification of the tissue(s) or cell type(s). For a number of disorders of the above tissues or cells, particularly of the central nervous, hematopoietic and immune systems, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful in the intervention or detection of pathologies associated with the hematopoietic and immune systems, such as anemias (leukemias). Expression of this gene product in immune cells suggests a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immune deficiency diseases such as AIDS, leukemia, rheumatoid arthritis, inflammatory bowel disease, sepsis, acne, and psoriasis. In addition, this gene product may have commercial utility in the expansion of stem cells and committed progenitors of various blood lineages, and in the differentiation and/or proliferation of various cell types. In addition, the expression in brain (including fetal) might suggest a role in developmental brain defects, neurodegenerative diseases or behavioral abnomalities (e.g. schizophrenia, Alzheimer's, dementia, depression, etc.). Protein, as well as, antibodies directed against the protein may show utility as a tumor marker and/or immunotherapy targets for the above listed tissues.

Preferred epitopes include those comprising a sequence shown in SEQ ID NO.375 as residues: Thr-48 to Ala-66.

Many polynucleotide sequences, such as EST sequences, are publicly available and accessible through sequence databases. Some of these sequences are related to SEQ ID NO:66 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 718 of SEQ ID NO:66, b is an integer of 15 to 732, where both a and b correspond to the positions of nucleotide residues shown in SEQ ID NO:66, and where the b is greater than or equal to a+14.

Features of Protein Encoded by Gene No: 57

It has been discovered that this gene is expressed primarily in lung, and to a lesser extent in a variety of other hematological cell types (e.g. Raji cells, bone marrow cell line, activated monocytes).

Therefore, nucleic acids of the invention are useful as reagents for differential identification of the tissue(s) or cell type(s) present in a biological sample and for diagnosis of the following diseases and conditions: pulmonary and/or hematological disfunction. Similarly, polypeptides and antibodies directed to those polypeptides are useful to provide immunological probes for differential identification of the tissue(s) or cell type(s). For a number of disorders of the above tissues or cells, particularly of the vasculo-pulmonary and hematopoietic systems, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful in the intervention and detection of pathologies associated with the vasculo-pulmonary system. In addition the expression of this gene in a variety of leukocytic cell types and a bone marrow cell line might suggest a role in hematopoietic and immune system disorders, such as leukemias & lymphomas, inflammation, immunodeficiencies and autoimmunities.

Preferred epitopes include those comprising a sequence shown in SEQ ID NO.376 as residues: Met-1 to Glu-7, Arg-39 to Ser-55, Lys-59 to Glu-66, Leu-70 to Asn-77.

Many polynucleotide sequences, such as EST sequences, are publicly available and accessible through sequence databases. Some of these sequences are related to SEQ ID NO:67 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 617 of SEQ ID NO:67, b is an integer of 15 to 631, where both a and b correspond to the positions of nucleotide residues shown in SEQ ID NO:67, and where the b is greater than or equal to a+14.

Features of Protein Encoded by Gene No: 58

The translation product of this gene shares sequence homology with adenylate kinase isozyme 3 (gi| 163528 GTP:AMP phosphotransferase (EC 2.7.4.10) [Bos taurus]), which is thought to be important in catalyzing the phosphorylation of AMP to ADP in the presence of ATP or inorganic triphosphate.

It has been discovered that this gene is expressed primarily in fetal liver, heart and placenta, and to a lesser extent in many other tissues.

Therefore, nucleic acids of the invention are useful as reagents for differential identification of the tissue(s) or cell type(s) present in a biological sample and for diagnosis of the following diseases and conditions: hepatic, cardiovascular or reproductive disorders. Similarly, polypeptides and antibodies directed to those polypeptides are useful to provide immunological probes for differential identification of the tissue(s) or cell type(s). For a number of disorders of the above tissues or cells, particularly of the hepatic, cardiovascular and reproductive systems, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for the treatment and diagnosis of conditions related to hepatic function and pathogenesis, in particular, those dealing with liver development and the differentiation of hepatocyte progenitor cells. Protein, as well as, antibodies directed against the protein may show utility as a tumor marker and/or immunotherapy targets for the above listed tissues.

Preferred epitopes include those comprising a sequence shown in SEQ ID NO.377 as residues: Gln-160 to Glu-167, Glu-177 to Pro-1 82, Ser-197 to Ile-204, Lys-215 to Ser-224.

Many polynucleotide sequences, such as EST sequences, are publicly available and accessible through sequence databases. Some of these sequences are related to SEQ ID NO:68 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1737 of SEQ ID NO:68, b is an integer of 15 to 1751, where both a and b correspond to the positions of nucleotide residues shown in SEQ ID NO:68, and where the b is greater than or equal to a+14.

Features of Protein Encoded by Gene No: 59

It has been discovered that this gene is expressed primarily in CD34 positive cells (Cord Blood).

Therefore, nucleic acids of the invention are useful as reagents for differential identification of the tissue(s) or cell type(s) present in a biological sample and for diagnosis of the following diseases and conditions: hematopoietic differentiation and immune disorders. Similarly, polypeptides and antibodies directed to those polypeptides are useful to provide immunological probes for differential identification of the tissue(s) or cell type(s). For a number of disorders of the above tissues or cells, particularly of hematopoietic and immune systems, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful in the detection and treatment of conditions associated with CD34-positive cells, and therefore as a marker for cell differentiation in hematapoiesis, as well as immunological disorders. Expression of this gene product in hematopoietic cells suggests a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immune deficiency diseases such as AIDS, leukemia, rheumatoid arthritis, inflammatory bowel disease, sepsis, acne, and psoriasis. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues. Preferred epitopes include those comprising a sequence shown in SEQ ID NO.378 as residues: Lys-56 to Gly-71.

Many polynucleotide sequences, such as EST sequences, are publicly available and accessible through sequence databases. Some of these sequences are related to SEQ ID NO:69 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 494 of SEQ ID NO:69, b is an integer of 15 to 508, where both a and b correspond to the positions of nucleotide residues shown in SEQ ID NO:69, and where the b is greater than or equal to a+14.

Features of Protein Encoded by Gene No: 60

Preferred epitopes include those comprising a sequence shown in SEQ ID NO.379 as residues: Asp-35 to Lys-49.

Many polynucleotide sequences, such as EST sequences, are publicly available and accessible through sequence databases. Some of these sequences are related to SEQ ID NO:70 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 231 of SEQ ID NO:70, b is an integer of 15 to 245, where both a and b correspond to the positions of nucleotide residues shown in SEQ ID NO:70, and where the b is greater than or equal to a+14.

Features of Protein Encoded by Gene No: 61

It has been discovered that this gene is expressed primarily in schizophrenic frontal cortex.

Therefore, nucleic acids of the invention are useful as reagents for differential identification of the tissue(s) or cell type(s) present in a biological sample and for diagnosis of the following diseases and conditions: nervous system and cognitive disorders. Similarly, polypeptides and antibodies directed to those polypeptides are useful to provide immunological probes for differential identification of the tissue(s) or cell type(s). For a number of disorders of the above tissues or cells, particularly of the frontal cortex and CNS expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for study, treatment and diagnosis of frontal cortex, neuro-degenerative and CNS disorders such as Alzheimers Disease, Parkinsons Disease, Huntingtons Disease, Tourette Syndrome, schizophrenia, mania, dementia, paranoia, obsessive compulsive disorder, panic disorder, learning disabilities, ALS, psychoses, autism, and altered bahaviors, including disorders in feeding, sleep patterns, balance, and perception. In addition, the gene or gene product may also play a role in the treatment and/or detection of developmental disorders associated with the developing embryo, sexually-linked disorders, or disorders of the cardiovascular system. Protein, as well as, antibodies directed against the protein may show utility as a tumor marker and/or immunotherapy targets for the above listed tissues.

Preferred epitopes include those comprising a sequence shown in SEQ ID NO.380 as residues: Thr-22 to Thr-27.

Many polynucleotide sequences, such as EST sequences, are publicly available and accessible through sequence databases. Some of these sequences are related to SEQ ID NO:71 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 347 of SEQ ID NO:71, b is an integer of 15 to 361, where both a and b correspond to the positions of nucleotide residues shown in SEQ ID NO:71, and where the b is greater than or equal to a+14.

Features of Protein Encoded by Gene No: 62

It has been discovered that this gene is expressed primarily in human adrenal gland tumor, and to a lesser extent in human kidney medulla and adult pulmonary tissue.

Therefore, nucleic acids of the invention are useful as reagents for differential identification of the tissue(s) or cell type(s) present in a biological sample and for diagnosis of the following diseases and conditions: metabolic and endocrine disorders. Similarly, polypeptides and antibodies directed to those polypeptides are useful to provide immunological probes for differential identification of the tissue(s) or cell type(s). For a number of disorders of the above tissues or cells, particularly of the endocrine and nervous system disorders and neoplasia,expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for study, treatment and diagnosis of neurological and endocrine disorders including neoplasia. Protein, as well as, antibodies directed against the protein may show utility as a tumor marker and/or immunotherapy targets for the above listed tissues.

Preferred epitopes include those comprising a sequence shown in SEQ ID NO.381 as residues: Ile-20 to Leu-25.

Many polynucleotide sequences, such as EST sequences, are publicly available and accessible through sequence databases. Some of these sequences are related to SEQ ID NO:72 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 699 of SEQ ID NO:72, b is an integer of 15 to 713, where both a and b correspond to the positions of nucleotide residues shown in SEQ ID NO:72, and where the b is greater than or equal to a+14.

Features of Protein Encoded by Gene No: 63

It has been discovered that this gene is expressed primarily in human adipocytes, and to a lesser extent in spleen, 12-week old human, and testes.

Therefore, nucleic acids of the invention are useful as reagents for differential identification of the tissue(s) or cell type(s) present in a biological sample and for diagnosis of the following diseases and conditions: immune, metabolic and growth disorders. Similarly, polypeptides and antibodies directed to those polypeptides are useful to provide immunological probes for differential identification of the tissue(s) or cell type(s). For a number of disorders of the above tissues or cells, particularly of the immune system, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for study, diagnosis and treatment of immune, developmental and metabolic disorders. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:73 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 848 of SEQ ID NO:73, b is an integer of 15 to 862, where both a and b correspond to the positions of nucleotide residues shown in SEQ ID NO:73, and where the b is greater than or equal to a+14.

Features of Protein Encoded by Gene No: 64

One translated product of this clone is homologous to the mouse zinc finger protein PZF. (See Accession No. 453376; see also Gene 152 (2), 233–238 (1995).) Preferred polypeptide fragments correspond to the highly conserved domains shared between mouse and man. For example, preferred polypeptide fragments comprise the amino acid sequence: LQCEICGFTCRQKASLNWHMKKHDADS-FYQFSCNICGKKFEKKDSVVAHKAKSHPEV (SEQ ID NO:674), ITSTDILGTNPESLTQPSD (SEQ ID NO:675), NSTSGECLLLEAEGMSKSY (SEQ ID NO:676), CSGTERVSLMADGKIFVGSGSSG GTEGLVMNSDIL-GATTEVLIEDSDSAGP (SEQ ID NO:677), IQYVRCE-MEGCGTVLAHPRYLQH-HIKYQHLLKKKYVCPHPSCGRLFRLQKQLLRHAKH HT (SEQ ID NO:678), DQRDYICEYCA-RAFKSSHNLAVHRMIHTGEK (SEQ ID NO:679), SALPQEVSIAASRPSRGWRSSRTSVS-RHRDTENTRSSRSKTGSLQLICK SEPNTDQLDY (SEQ ID NO:680), PFKDDPRDETYKPHLERETPKPRRKSG (SEQ ID NO:681), QYVRCEMEGCGTVLAHPRYLQH-HIKYQHLLKKKYVCPHPSCGRLFRL QKQLLRHA-KHHTD (SEQ ID NO:682), and QRDYICEYCA-RAFKSSHNLAVHRMI HTGEKHY (SEQ ID NO:683). Also preferred are polynucleotide fragments encoding these polypeptide fragments. When tested against renal messangial cell lines, supernatants removed from cells containing this gene induced a calcium flux in the renal cells tested in the FLIPR assay (small molecule concentration and membrane permeability assay). Thus, it is likely that this gene activates renal messangial cells via the binding of a ligand to a receptor. The FLIPR assay indicates the binding of a ligand to a receptor, which is known to alter intracellular levels of small molecules, such as calcium, potassium, sodium, and pH, as well as alter membrane potential. Alterations in small molecule concentration can be measured to identify supernatants which bind to receptors of a perticular cell.

It has been discovered that this gene is expressed primarily in Rhabdomyosarcoma, Melanocyte and colon cancer tissue and to a lesser extent in smooth muscle, pancreatic tumor, and apoptotic T cells.

Therefore, nucleic acids of the invention are useful as reagents for differential identification of the tissue(s) or cell type(s) present in a biological sample and for diagnosis of the following diseases and conditions: cancer. Similarly, polypeptides and antibodies directed to those polypeptides are useful to provide immunological probes for differential identification of the tissue(s) or cell type(s). For a number of disorders of the above tissues or cells, particularly of the immune and hemopoetic, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for study, diagnosis and treatment of cancer and hematopoietic disorders. Protein, as well as, antibodies directed against the protein may show utility as a tumor marker and/or immunotherapy targets for the above listed tissues.

Preferred epitopes include those comprising a sequence shown in SEQ ID NO.383 as residues: Phe-10 to Ile-46, Val-54 to Pro-91, Lys-123 to Pro-129, His-150 to Tyr-156, Thr-179 to Asn-185.

Many polynucleotide sequences, such as EST sequences, are publicly available and accessible through sequence databases. Some of these sequences are related to SEQ ID NO:74 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 4588 of SEQ ID NO:74, b is an integer of 15 to 4602, where both a and b correspond to the positions of nucleotide residues shown in SEQ ID NO:74, and where the b is greater than or equal to a+14.

Features of Protein Encoded by Gene No: 65

It has been discovered that this gene is expressed primarily in human adipose and salivary gland tissue and to a lesser extent in human bone marrow and fetal kidney.

Therefore, nucleic acids of the invention are useful as reagents for differential identification of the tissue(s) or cell type(s) present in a biological sample and for diagnosis of the following diseases and conditions: metabolic and immune disorders. Similarly, polypeptides and antibodies directed to those polypeptides are useful to provide immunological probes for differential identification of the tissue(s) or cell type(s). For a number of disorders of the above tissues or cells, particularly of the metabolic and hematopoietic systems, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for study, diagnosis of metabolic and immune disorders. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:75 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1241 of SEQ ID NO:75, b is an integer of 15 to 1255, where both a and b correspond to the positions of nucleotide residues shown in SEQ ID NO:75, and where the b is greater than or equal to a+14.

Features of Protein Encoded by Gene No: 66

This translated product of this gene was recently identified as oxytocinase splice variant 1. (See Accession Nos. 2209276 and d1010078.) Preferred polypeptide fragments comprise the amino acid sequence: EMFDSLSYFKGSS-LLLMLKTYLSEDVFQHAVV LYLHNHSYAS IQSDDLWDSFNEVTNQTLDVKRMMKTW-fLQKGFPLVTVQK KGKELFIQQERFFLNMKPEIQPS-DTRYM (SEQ ID NO:739). Also preferred are polynucleotide fragments encoding this polypeptide fragment. The gene encoding the disclosed cDNA is believed to reside on chromosome 5. Accordingly, polynucleotides related to this invention are useful as a marker in linkage analysis for chromosome 5.

This gene is expressed primarily in tonsils, and to a lesser extent,in fetal liver spleen.

Therefore, nucleic acids of the invention are useful as reagents for differential identification of the tissue(s) or cell type(s) present in a biological sample and for diagnosis of the following diseases and conditions: immune, hematopoietic, or developmental disorders. Similarly, polypeptides and antibodies directed to those polypeptides are useful to provide immunological probes for differential identification of the tissue(s) or cell type(s). For a number of disorders of the above tissues or cells, particularly of the immune or hematopoietic system, expression of this gene at significantly higher or lower levels may be detected in certain tissues or cell types (e.g.immune, hematopoietic, developmental, hepatic, and cancerous and wounded tissues) or bodily fluids (e.g.lymph, amniotic fluid, bile, serum, plasma, urine, synovial fluid or spinal fluid) taken from an individual having such a disorder, relative to the standard gene expression level, i.e., the expression level in healthy tissue from an individual not having the disorder.

The tissue distribution in fetal liver spleen and tonsils suggests that the protein product of this clone would be useful for the treatment and diagnosis of hematopoetic related disorders such as anemia, pancytopenia, leukopenia, thrombocytopenia or leukemia since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Similarly, expression within fetal tissue and other cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Preferred epitopes include those comprising a sequence shown in SEQ ID NO.385 as residues: Pro-99 to Tyr-108.

Many polynucleotide sequences, such as EST sequences, are publicly available and accessible through sequence databases. Some of these sequences are related to SEQ ID NO:76 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 461 of SEQ ID NO:76, b is an integer of 15 to 475, where both a and b correspond to the positions of nucleotide residues shown in SEQ ID NO:76, and where the b is greater than or equal to a+14.

Features of Protein Encoded by Gene No: 67

It has been discovered that this gene is expressed primarily in hematopoietic cells, particularly apoptotic T-cells, and to lesser extent in primary dendritic cells and adipose tissue.

Therefore, nucleic acids of the invention are useful as reagents for differential identification of apoptotic T-cells, primary dendritic cells, and adipose tissue present in a biological sample and for diagnosis of the following diseases and conditions: hematopoietic diseases including cancer and general immune disorders. Similarly, polypeptides and antibodies directed to those polypeptides are useful to provide immunological probes for differential identification of the tissue(s) or cell type(s). For a number of disorders of the above tissues or cells, particularly of the oral and intestinal mucosa as well as hematopoietic and immune systems, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for treatment of diseases of the immune system, including cancer, hematopoietic and infectious diseases. Protein, as well as, antibodies directed against the protein may show utility as a tumor marker and/or immunotherapy targets for the above listed tissues.

Preferred epitopes include those comprising a sequence shown in SEQ ID NO.386 as residues: Ala-2 to Ala-9, Ser-36 to Trp-41.

Many polynucleotide sequences, such as EST sequences, are publicly available and accessible through sequence databases. Some of these sequences are related to SEQ ID NO:77 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 451 of SEQ ID NO:77, b is an integer of 15 to 465, where both a and b correspond to the positions of nucleotide residues shown in SEQ ID NO:77, and where the b is greater than or equal to a+14.

Features of Protein Encoded by Gene No: 68

It has been discovered that this gene is expressed primarily in kidney cortex and to a lesser extent in infant brain, heart, uterus, and blood.

Therefore, nucleic acids of the invention are useful as reagents for differential identification of kidney tissue present in a biological sample and for diagnosis of the following diseases and conditions: soft tissue cancer, inflammation, kidney fibrosis. Similarly, polypeptides and antibodies directed to those polypeptides are useful to provide immunological probes for differential identification of the tissue(s) or cell type(s). For a number of disorders of the above tissues or cells, particularly of the nervous and endocrines systems, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for study and treatment of cancer and fibroses. Protein, as well as, antibodies directed against the protein may show utility as a tumor marker and/or immunotherapy targets for the above listed tissues.

Preferred epitopes include those comprising a sequence shown in SEQ ID NO.387 as residues: Arg-8 to Lys-20, Asp-28 to Glu-33, Val-42 to Thr-47, Glu-52 to Ser-57, Thr-65 to Phe-73, Gly-75 to Tyr-85, Ala-90 to Arg-95, Arg-111 to Gln-124, Lys-134 to Ser-140, Phe-165 to Asp-170, Pro-199 to Cys-205, Gly-239 to Val-244, Glu-247 to Trp-253, Tyr-319 to Gln-326, Leu-423 to Asn-433.

Many polynucleotide sequences, such as EST sequences, are publicly available and accessible through sequence databases. Some of these sequences are related to SEQ ID NO:78 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1893 of SEQ ID NO:78, b is an integer of 15 to 1907, where both a and b correspond to the positions of nucleotide residues shown in SEQ ID NO:78, and where the b is greater than or equal to a+14.

Features of Protein Encoded by Gene No: 69

The translation product of this gene shares strong sequence homology with vertebrate and invertebrate protein tyrosine phosphatases. The gene encoding the disclosed cDNA is thought to reside on chromosome 1. Accordingly, polynucleotides related to this invention are useful as a marker in linkage analysis for chromosome 1.

It has been discovered that this gene is expressed primarily in endometrial tumors, melanocytes, myeloid progenitors and to a lesser extent in infant brain, adipocytes, and several hematopoietic stem cells. Therefore, nucleic acids of the invention are useful as reagents for differential identification of transformed hematopoietic and epithelial cells present in a biological sample and for diagnosis of the following diseases and conditions: cancer of skin and endometrium, leukemia. Similarly, polypeptides and antibodies directed to those polypeptides are useful to provide immunological probes for differential identification of the tissue(s) or cell type(s). For a number of disorders of the above tissues or cells, particularly of the nervous and hematopoietic systems, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution and sequence similarity with tyrosine phosphatases suggests that the protein product of this clone would be useful for study and treatment of cancer and hematopoietic disorders. Expression within embryonic tissue and other cellular sources marked by proliferating cells suggests that this protein may play a role in the regulation of cellular division. Additionally, the expression in hematopoietic cells and tissues suggests that this protein may play a role in the proliferation, differentiation, and/or survival of hematopoietic cell lineages. In such an event, this gene may be useful in the treatment of lymphoproliferative disorders, and in the maintenance and differentiation of various hematopoietic lineages from early hematopoietic stem and committed progenitor cells. Similarly, embryonic development also involves decisions involving cell differentiation and/or apoptosis in pattern formation. Thus, this protein may also be involved in apoptosis or tissue differentiation and could again be useful in cancer therapy. Protein, as well as, antibodies directed against the protein may show utility as a tumor marker and/or immunotherapy targets for the above listed tissues.

Preferred epitopes include those comprising a sequence shown in SEQ ID NO.388 as residues: Met-1 to Gly-6.

Many polynucleotide sequences, such as EST sequences, are publicly available and accessible through sequence databases. Some of these sequences are related to SEQ ID NO:79 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1154 of SEQ ID NO:79, b is an integer of 15 to 1168, where both a and b correspond to the positions of nucleotide residues shown in SEQ ID NO:79, and where the b is greater than or equal to a+14.

Features of Protein Encoded by Gene No: 70

The gene encoding the disclosed cDNA is thought to reside on chromosome 2. Thus, polynucleotides related to this invention are useful as a marker in linkage analysis for chromosome 2.

It has been discovered that this gene is expressed primarily in osteoclastoma, breast, and infant brain and to a lesser extent in various fetal and transformed bone, ovarian, and neuronal cells.

Therefore, nucleic acids of the invention are useful as reagents for differential identification of the tissue(s) or cell type(s) present in a biological sample and for diagnosis of the following diseases and conditions: degenerative conditions of the brain and skeleton. Similarly, polypeptides and antibodies directed to those polypeptides are useful to provide immunological probes for differential identification of the tissue(s) or cell type(s). For a number of disorders of the above tissues or cells, particularly of the nervous and skeletal system, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for study and treatment of degenerative, neurological and skeletal disorders. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:80 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1271 of SEQ ID NO:80, b is an integer of 15 to 1285, where both a and b correspond to the positions of nucleotide residues shown in SEQ ID NO:80, and where the b is greater than or equal to a+14.

Features of Protein Encoded by Gene No: 71

This gene was originally cloned from tumor cell lines. Recently another group has also cloned this gene, calling it the human malignant melanoma metastasis-suppressor (KiSS-1) gene. (See Accession No. U43527). Preferred polypeptide fragments comprise the amino acid sequence: LEKVASVGNSRPTGQQLESLGLLA (SEQ ID NO:685), VHREEASCYCQAEPSGDL (SEQ ID NO:686), RPAL-RQAGGGTREPRQKRWAGL (SEQ ID NO:687), and AVNFRPQRSQSM (SEQ ID NO:688). Any frame shifts can easily be resolved using known molecular biology techniques. The gene encoding the disclosed cDNA is thought to reside on chromosome 1. Accordingly, polynucleotides related to this invention are useful as a marker in linkage analysis for chromosome 1.

This gene is expressed primarily in many types of carcinomas and to a lesser extent in many normal organs.

Therefore, polynucleotides and polypeptides of the invention are useful as reagents for differential identification of the tissues(s) or cell type(s) present in a biological sample and for diagnosis of the following diseases and conditions: cancer, particularly melanomas, and other hyperproliferative disorders. Similarly, polypepides and antibodies directed to those polypeptides are useful to provide immunological probes for differential identification of the tissue(s) or cell type(s). For a number of disorders of the above tissues or cells, particularly of transformed organ tissue, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder. As a tumor suppressor gene, increase amounts of the polypeptide can be used to treat patients having a particular cancer.

The tissue distribution indicates that this gene and the translated product is useful for the diagnosis and study of cancer. Protein, as well as, antibodies directed against the protein may show utility as a tumor marker and/or immunotherapy targets for the above listed tissues.

Preferred epitopes include those comprising a sequence shown in SEQ ID NO.390 as residues: Gly-29 to Leu-38, Pro-52 to Ala-59, Ser-65 to Ser-70, Pro-73 to Gly-85, Pro-89 to Pro-95, Arg-105 to Trp-114, Pro-128 to Arg-137.

Many polynucleotide sequences, such as EST sequences, are publicly available and accessible through sequence databases. Some of these sequences are related to SEQ ID NO:81 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1276 of SEQ ID NO:8 1, b is an integer of 15 to 1290, where both a and b correspond to the positions of nucleotide residues shown in SEQ ID NO:81, and where the b is greater than or equal to a+14.

Features of Protein Encoded by Gene No: 72

It has been discovered that this gene is expressed primarily in striatum and to a lesser extent in adipocytes and hemangioperiocytoma.

Therefore, nucleic acids of the invention are useful as reagents for differential identification of striatal cells present in a biological sample and for diagnosis of the following diseases and conditions: neurological disorders as well as fat and lysosomal storage diseases. Similarly, polypeptides and antibodies directed to those polypeptides are useful to provide immunological probes for differential identification of the tissue(s) or cell type(s). For a number of disorders of the above tissues or cells, particularly of the nervous and immune systems, expression of this gene at significantly higher or lower levels may be detected in certain tissues (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for diagnosis, study and treatment of neurodegenerative and growth disorders, such as Alzheimers Disease, Parkinsons Disease, Huntingtons Disease, Tourette Syndrome, and schizophrenia. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:82 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 670 of SEQ ID NO:82, b is an integer of 15 to 684, where both a and b correspond to the positions of nucleotide residues shown in SEQ ID NO:82, and where the b is greater than or equal to a+14.

Features of Protein Encoded by Gene No: 73

It has been discovered that this gene is expressed primarily in bone marrow stromal cells and to a lesser extent in smooth muscle, testes, endothelium, and brain.

Therefore, nucleic acids of the invention are useful as reagents for differential identification of bone marrow present in a biological sample and for diagnosis of the following diseases and conditions: connective tissue and hematopoietic diseases. Similarly, polypeptides and antibodies directed to those polypeptides are useful to provide immunological probes for differential identification of the tissue(s) or cell type(s). For a number of disorders of the above tissues or cells, particularly of the skeletal and hematopoietic systems, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for study, diagnosis, and treatment of connective tissue and blood diseases. Protein, as well as, antibodies directed against the protein may show utility as a tumor marker and/or immunotherapy targets for the above listed tissues.

Preferred epitopes include those comprising a sequence shown in SEQ ID NO.392 as residues: Thr-17 to Glu-24, Gly-28 to Pro-45, Ser-47 to Pro-59, Lys-62 to Asp-79, Gly-91 Gly-99, Ser-144 to Leu-157, Gln-199 to Thr-210, Thr-215 to Ser-221, Pro-231 to Ser-247.

Many polynucleotide sequences, such as EST sequences, are publicly available and accessible through sequence databases. Some of these sequences are related to SEQ ID NO:83 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2010 of SEQ ID NO:83, b is an integer of 15 to 2024, where both a and b correspond to the positions of nucleotide residues shown in SEQ ID NO:83, and where the b is greater than or equal to a+14.

Features of Protein Encoded by Gene No: 74

The gene encoding the disclosed cDNA is believed to reside on chromosome 12. Accordingly, polynucleotides related to this invention are useful as a marker in linkage analysis for chromosome 12.

It has been discovered that this gene is expressed primarily in brain, fetal liver and lung and to a lesser extent in retina, spinal chord, activated T-cells and endothelial cells.

Therefore, nucleic acids of the invention are useful as reagents for differential identification of brain and regenerating liver present in a biological sample and for diagnosis of the following diseases and conditions: CNS and spinal chord injuries, immune disorders. Similarly, polypeptides and antibodies directed to those polypeptides are useful to provide immunological probes for differential identification of the tissue(s) or cell type(s). For a number of disorders of the above tissues or cells, particularly of the nervoius and immune system, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for study and treatment of hematopoietic disorders, such as anemia, pancytopenia, leukopenia, thrombocytopenia or leukemia. Furthermore, the tissue distribution also suggests that the protein product of this clone would be useful for the study and treatment of neurological disorders such as Alzheimers Disease, Parkinsons Disease, Huntingtons Disease, Tourette Syndrome, and schizophrenia.

Preferred epitopes include those comprising a sequence shown in SEQ ID NO.393 as residues: Pro-55 to Lys-63.

Many polynucleotide sequences, such as EST sequences, are publicly available and accessible through sequence databases. Some of these sequences are related to SEQ ID NO:84 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 917 of SEQ ID NO:84, b is an integer of 15 to 931, where both a and b correspond to the positions of nucleotide residues shown in SEQ ID NO:84, and where the b is greater than or equal to a+14.

Features of Protein Encoded by Gene No: 75

The translation product of this gene shares sequence homology with GTP binding proteins (intracellular).

It has been discovered that this gene is expressed primarily in bone marrow, brain, and melanocytes and to a lesser extent in various endocrine and hematopoietic tissues.

Therefore, nucleic acids of the invention are useful as reagents for differential identification of the tissue(s) or cell type(s) present in a biological sample and for diagnosis of the following diseases and conditions: hematopietic and nervous system conditions. Similarly, polypeptides and antibodies directed to those polypeptides are useful to provide immunological probes for differential identification of the tissue(s) or cell type(s). For a number of disorders of the above tissues or cells, particularly of the nervous and immune, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution and homology to nucleotide binding factors suggests that the protein product of this clone would be useful for study, diagnosis, and treatment of brain degenerative, skin and blood diseases. Protein, as well as, antibodies directed against the protein may show utility as a tumor marker and/or immunotherapy targets for the above listed tissues.

Preferred epitopes include those comprising a sequence shown in SEQ ID NO.394 as residues: Ala-3 to Glu-12, Glu-36 to Thr-41, Val-49 to Leu-60.

Many polynucleotide sequences, such as EST sequences, are publicly available and accessible through sequence databases. Some of these sequences are related to SEQ ID NO:85 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 811 of SEQ ID NO:85, b is an integer of 15 to 825, where both a and b correspond to the positions of nucleotide residues shown in SEQ ID NO:85, and where the b is greater than or equal to a+14.

Features of Protein Encoded by Gene No: 76

It has been discovered that this gene is expressed primarily in activated T-cells and to a lesser extent in retina, brain, and fetal bone.

Therefore, nucleic acids of the invention are useful as reagents for differential identification of activated T-cells and developing brain present in a biological sample and for diagnosis of the following diseases and conditions: immune deficiencies and skeletal and neuronal growth disorders. Similarly, polypeptides and antibodies directed to those polypeptides are useful to provide immunological probes for differential identification of the tissue(s) or cell type(s). For a number of disorders of the above tissues or cells, particularly of the nervous, immune, and skeletomuscular systems, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for diagnosis, study and treatment of cancer, urogenital, and brain degenerative diseases. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:86 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1224 of SEQ ID NO:86, b is an integer of 15 to 1238, where both a and b correspond to the positions of nucleotide residues shown in SEQ ID NO:86, and where the b is greater than or equal to a+14.

Features of Protein Encoded by Gene No: 77

It has been discovered that this gene is expressed primarily in fetal liver, activated monocytes, osteoblasts and to a lesser extent in synovial, brain, and lymphoid tissues.

Therefore, nucleic acids of the invention are useful as reagents for differential identification of myeloid and lymphoid present in a biological sample and for diagnosis of the following diseases and conditions: inflammation, immune deficiencies, cancer. Similarly, polypeptides and antibodies directed to those polypeptides are useful to provide immunological probes for differential identification of the tissue(s) or cell type(s). For a number of disorders of the above tissues or cells, particularly of the immune system and skeleton, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for study, diagnosis, and treatment of lymphoid and mesenchymal cancers and nervous system diseases. Protein, as well as, antibodies directed against the protein may show utility as a tumor marker and/or immunotherapy targets for the above listed tissues.

Preferred epitopes include those comprising a sequence shown in SEQ ID NO.396 as residues: Asp-129 to Ser-134, Arg-159 to Ala-168, Arg-258 to Pro-264.

Many polynucleotide sequences, such as EST sequences, are publicly available and accessible through sequence databases. Some of these sequences are related to SEQ ID NO:87 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1446 of SEQ ID NO:87, b is an integer of 15 to 1460, where both a and b correspond to the positions of nucleotide residues shown in SEQ ID NO:87, and where the b is greater than or equal to a+14.

Features of Protein Encoded by Gene No: 78

The translation product of this gene shares sequence homology with polymerase polyprotein precursor which is thought to be important in DNA repair and replication It has been discovered that this gene is expressed primarily in infant brain and to a lesser extent in tumors and tumor cell lines Therefore, nucleic acids of the invention are useful as reagents for differential identification of the tissue(s) or cell type(s) present in a biological sample and for diagnosis of the following diseases and conditions: cancer, especially of the neural system and developing organs. Similarly, polypeptides and antibodies directed to those polypeptides are useful to provide immunological probes for differential identification of the tissue(s) or cell type(s). For a number of disorders of the above tissues or cells, particularly of the neural system expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution and homology to polymerase polyprotein precursor suggests that the protein product of this clone would be useful for diagnosis and treatment of cancers, especially of the neural system and developing organs. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:88 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1381 of SEQ ID NO:88, b is an integer of 15 to 1395, where both a and b correspond to the positions of nucleotide residues shown in SEQ ID NO:88, and where the b is greater than or equal to a+14.

Features of Protein Encoded by Gene No: 79

It has been discovered that this gene is expressed primarily in muscle and endothelial cells and to a lesser extent in brain.

Therefore, nucleic acids of the invention are useful as reagents for differential identification of the tissue(s) or cell type(s) present in a biological sample and for diagnosis of the following diseases and conditions: vascular diseases. Similarly, polypeptides and antibodies directed to those polypeptides are useful to provide immunological probes for differential identification of the tissue(s) or cell type(s). For a number of disorders of the above tissues or cells, particularly of the vascular system, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for treatment and diagnosis of disorders of the vascular and neural system including cardiovascular and endothelial. Protein, as well as, antibodies directed against the protein may show utility as a tumor marker and/or immunotherapy targets for the above listed tissues.

Preferred epitopes include those comprising a sequence shown in SEQ ID NO.398 as residues: Tyr-5 to Glu-13.

Many polynucleotide sequences, such as EST sequences, are publicly available and accessible through sequence databases. Some of these sequences are related to SEQ ID NO:89 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1172 of SEQ ID NO:89, b is an integer of 15 to 1186, where both a and b correspond to the positions of nucleotide residues shown in SEQ ID NO:89, and where the b is greater than or equal to a+14.

Features of Protein Encoded by Gene No: 80

This gene appears to be a human homolog of a mouse metalloproteinase/disintegrin protein, which is thought to play a role in skeletal muscle development involving the formation of multi-nucleated myotubes. The gene encoding the disclosed cDNA is believed to reside on chromosome 10. Accordingly, polynucleotides related to this invention are useful as a marker in linkage analysis of chromosome 10.

It has been discovered that this gene is expressed primarily in placenta and to a lesser extent in fetal liver Therefore, nucleic acids of the invention are useful as reagents for differential identification of the tissue(s) or cell type(s) present in a biological sample and for diagnosis of the following diseases and conditions: developmental disorders and disorder of the haemopoietic system, fetal liver and placenta. Similarly, polypeptides and antibodies directed to those polypeptides are useful to provide immunological probes for differential identification of the tissue(s) or cell type(s). For a number of disorders of the above tissues or cells, particularly of developmental disorders and disorder of the hematopoietic system, fetal liver and placenta, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for diagnosis and treatment of developmental disorders and disorders of the hematopoietic system, fetal liver and placenta. Alternatively, the tissue distribution and nucleotide homology to metalloproteinase/disintegrin protein suggest that the translation product of this gene may be important in the fetal development of skeletal muscle. Protein, as well as, antibodies directed against the protein may show utility as a tumor marker and/or immunotherapy targets for the above listed tissues.

Preferred epitopes include those comprising a sequence shown in SEQ ID NO.399 as residues: Cys-34 to Tyr-41, Lys-53 to Lys-68.

Many polynucleotide sequences, such as EST sequences, are publicly available and accessible through sequence databases. Some of these sequences are related to SEQ ID NO:90 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1807 of SEQ ID NO:90, b is an integer of 15 to 1821, where both a and b correspond to the positions of nucleotide residues shown in SEQ ID NO:90, and where the b is greater than or equal to a+14.

Features of Protein Encoded by Gene No: 81

It has been discovered that this gene is expressed primarily in bone marrow, placenta and tissues and organs of the hematopoietic system Therefore, nucleic acids of the invention are useful as reagents for differential identification of the tissue(s) or cell type(s) present in a biological sample and for diagnosis of the following diseases and conditions: disorders of the bone and hematopoietic system. Similarly, polypeptides and antibodies directed to those polypeptides are useful to provide immunological probes for differential identification of the tissue(s) or cell type(s). For a number of disorders of the above tissues or cells, particularly of the immune, bone and hematopoietic system, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for diagnosis and treatment of disorders of the immune, bone and hematopoietic system, such as anemia, pancytopenia, leukopenia, thrombocytopenia or leukemia. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:91 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 848 of SEQ ID NO:9 1, b is an integer of 15 to 862, where both a and b correspond to the positions of nucleotide residues shown in SEQ ID NO:91, and where the b is greater than or equal to a+14.

Features of Protein Encoded by Gene No: 82

The translation product of this gene shares sequence homology with secretory carrier membrane protein which is thought to be important in protein transport and export. Any frame shifts in coding sequence can be easily resolved using standard molecular biology techniques. Another group recently cloned this gene, calling it SCAMP. (See Accession No. 2232243.). The gene encoding the disclosed cDNA is thought to reside on chromosome 1. Accordingly, the polynucleotides related to this invention are useful as a marker in linkage analysis of chromosome 1.

It has been discovered that this gene is expressed primarily in prostate, breast and spleen, and to a lesser extent in several other tissues and organs Therefore, nucleic acids of the invention are useful as reagents for differential identification of the tissue(s) or cell type(s) present in a biological sample and for diagnosis of the following diseases and conditions: disorders of the breast prostate and spleen. Similarly, polypeptides and antibodies directed to those polypeptides are useful to provide immunological probes for differential identification of the tissue(s) or cell type(s). For a number of disorders of the above tissues or cells, particularly disorders of the breast prostate and spleen, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution and homology to secretory carrier membrane protein suggests that the protein product of this clone would be useful for diagnosis and treatment of disorders of the breast, prostate and spleen. Protein, as well as, antibodies directed against the protein may show utility as a tumor marker and/or immunotherapy targets for the above listed tissues.

Preferred epitopes include those comprising a sequence shown in SEQ ID NO.401 as residues: Ala-2 to Glu-13, Ser-15 to Gln-22, Pro-43 to Ala-57, Gln-70 to Gln-89, Leu-100 to Ser-119.

Many polynucleotide sequences, such as EST sequences, are publicly available and accessible through sequence databases. Some of these sequences are related to SEQ ID NO:92 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 682 of SEQ ID NO:92, b is an integer of 15 to 696, where both a and b correspond to the positions of nucleotide residues shown in SEQ ID NO:92, and where the b is greater than or equal to a+14.

Features of Protein Encoded by Gene No: 83

It has been discovered that this gene is expressed primarily in developing organs and tissue like placenta and infant brain and to a lesser extent in developed organs and tissue like cerebellum and heart Therefore, nucleic acids of the invention are useful as reagents for differential identification of the tissue(s) or cell type(s) present in a biological sample and for diagnosis of the following diseases and conditions: neurological diseases. Similarly, polypeptides and antibodies directed to those polypeptides are useful to provide immunological probes for differential identification of the tissue(s) or cell type(s). For a number of disorders of the above tissues or cells, particularly of the neural system, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for treatment and diagnosis of diseases of the neural system including neurological disorders and cancer. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:93 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1872 of SEQ ID NO:93, b is an integer of 15 to 1886, where both a and b correspond to the positions of nucleotide residues shown in SEQ ID NO:93, and where the b is greater than or equal to a+14.

Features of Protein Encoded by Gene No: 84

The translation product of this gene shares sequence homology with ATPase 6 in Trypanosoma brucei which is thought to be important in metabolism.

It has been discovered that this gene is expressed primarily in tumor and fetal tissues and to a lesser extent in melanocytes, kidney cortex, monocytes and ovary.

Therefore, nucleic acids of the invention are useful as reagents for differential identification of the tissue(s) or cell type(s) present in a biological sample and for diagnosis of the following diseases and conditions: metabolism disorders. Similarly, polypeptides and antibodies directed to those polypeptides are useful to provide immunological probes for differential identification of the tissue(s) or cell type(s). For a number of disorders of the above tissues or cells, particularly of the fetal systems, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution and homology to ATPase indicates that the protein product of this clone would be useful for treatment and diagnosis of metabolism disorders, especially in fetal and tumor tissue growth. Protein, as well as, antibodies directed against the protein may show utility as a tumor marker and/or immunotherapy targets for the above listed tissues.

Preferred epitopes include those comprising a sequence shown in SEQ ID NO.403 as residues: Gln-17 to Ile-22, Gln-54 to Ser-60.

Many polynucleotide sequences, such as EST sequences, are publicly available and accessible through sequence databases. Some of these sequences are related to SEQ ID NO:94 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1760 of SEQ ID NO:94, b is an integer of 15 to 1774, where both a and b correspond to the positions of nucleotide residues shown in SEQ ID NO:94, and where the b is greater than or equal to a+14.

Features of Protein Encoded by Gene No: 85

The translation product of this gene shares sequence homology with the immunoglobulin superfamily of proteins which are known to be important in immune response and immunity.

It has been discovered that this gene is expressed primarily in stromal cells, colon cancer, lung, amygdala, melanocyte and to a lesser extent in a variety of other tissues.

Therefore, nucleic acids of the invention are useful as reagents for differential identification of the tissue(s) or cell type(s) present in a biological sample and for diagnosis of the following diseases and conditions: defects of stromal cell development and cancer. Similarly, polypeptides and antibodies directed to those polypeptides are useful to provide immunological probes for differential identification of the tissue(s) or cell type(s). For a number of disorders of the above tissues or cells, particularly of the stromal cells, expression of this gene at significantly higher or lower levels may be detected in certain tissues or cell types (e.g., cancerous and wounded tissues) or bodily fluids (e.g. lymph, serum, plasma, urine, synovial fluid or spinal fluid) taken from an individual having such a disorder, relative to the standard gene expression level, i.e., the expression level in healthy tissue from an individual not having the disorder.

The tissue distribution and homology to immunoglobulin indicates that the protein product of this clone would be useful for treatment and diagnosis of immune system disorders. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:95 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1765 of SEQ ID NO:95, b is an integer of 15 to 1779, where both a and b correspond to the positions of nucleotide residues shown in SEQ ID NO:95, and where the b is greater than or equal to a+14.

Features of Protein Encoded by Gene No: 86

The translation product of this gene shares sequence homology with transcription iniation factor eIF-4 gamma which is thought to be important in gene transcription. Additionally, the translation product of this gene shares significant homology to a Homo sapiens polyadenylate binding protein-interacting protein-1 (PAIP1), which could play a possible role as an RNA editing enzyme or polypeptide, the defect of which could lead to translational errors or cancer. One embodiment of this clone comprises polypeptides of the following amino acid sequence: HQP-PQPKAPGF (SEQ ID NO:689), GAQCEVPASPQRPSRP-GALPEQTRPLRAPPSSQDKIPQQNSESA-MAKPQVVVAPVLMSKL SVNAPEF (SEQ ID NO:690), EDGCEDYPTLSEYVQDFLNHLTEQPGSFETEI EQFA-ETLNGCVTTDDALQELVELIYQQATSIP-NFSYMGARLCNYLSHHLTISPQSGNFRQL LLQR-CRTEYEVKDQAAKGDEVTRKRFHAFVLFLGELYL NLEIKGTNGQVTRADILQVGLR ELLNALFSNPMDD-NLICAVKLLKLTGSVLEDAWKEKGKMD-MEEIIQRIENVVLDANCSRD VKQMLLKLVELRSSN-WGRVHATSTYREATPENDPNYFMNEPTFYTSDGVP FTAADPDYQ EKYQELLEREDFFPDYEENGTDLS-GAGDPYL (SEQ ID NO:691), or AYEKFCLESERKRKQ (SEQ ID NO:692). Recently another group published a paper in which they described a Homo sapiens polyadenylate binding protein-interacting protein-1 (PAIP1) MRNA, including the complete coding sequence (Genbank accession AF013758, Nature 392, 520–523 (1998)).

It has been discovered that this gene is expressed primarily in tumor tissues.

Therefore, nucleic acids of the invention are useful as reagents for differential identification of the tissue(s) or cell type(s) present in a biological sample and for diagnosis of the following diseases and conditions: tumorigenesis. Similarly, polypeptides and antibodies directed to those polypeptides are useful to provide immunological probes for differential identification of the tissue(s) or cell type(s). For a number of disorders of the above tissues or cells, particularly in tumor tissues, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution and homology to transcription iniation factor eIF-4 gamma and Homo sapiens polyadenylate binding protein-interacting protein-I (PAIP 1) suggests that the protein product of this clone would be useful for gene regulation in tumorigenesis. Protein, as well as, antibodies directed against the protein may show utility as a tumor marker and/or immunotherapy targets for the above listed tissues.

Preferred epitopes include those comprising a sequence shown in SEQ ID NO.405 as residues: Met-1 to Arg-15.

Many polynucleotide sequences, such as EST sequences, are publicly available and accessible through sequence databases. Some of these sequences are related to SEQ ID NO:96 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2787 of SEQ ID NO:96, b is an integer of 15 to 2801, where both a and b correspond to the positions of nucleotide residues shown in SEQ ID NO:96, and where the b is greater than or equal to a+14.

Features of Protein Encoded by Gene No: 87

The translation product of this gene shares sequence homology at low level in prolines with secreted basic proline-rich peptide II-2 which is thought to be important in protein structure or inhibiting hydroxyapatite formation in vitro.

It has been discovered that this gene is expressed primarily in endometrial tumor and fetal lung.

Therefore, nucleic acids of the invention are useful as reagents for differential identification of the tissue(s) or cell type(s) present in a biological sample and for diagnosis of the following diseases and conditions: endometrial tumors. Similarly, polypeptides and antibodies directed to those polypeptides are useful to provide immunological probes for differential identification of the tissue(s) or cell type(s). For a number of disorders of the above tissues or cells, particularly of the muscular/skeletal and reproductive systems, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution and homology to secreted basic proline-rich peptide 11-2 suggests that the protein product of this clone would be useful for inhibiting hydroxyapatite formation or establishing cell/tissue structure. Protein, as well as, antibodies directed against the protein may show utility as a tumor marker and/or immunotherapy targets for the above listed tissues.

Preferred epitopes include those comprising a sequence shown in SEQ ID NO.406 as residues: Glu-175 to Glu-193.

Many polynucleotide sequences, such as EST sequences, are publicly available and accessible through sequence databases. Some of these sequences are related to SEQ ID NO:97 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1617 of SEQ ID NO:97, b is an integer of 15 to 1631, where both a and b correspond to the positions of nucleotide residues shown in SEQ ID NO:97, and where the b is greater than or equal to a+14.

Features of Protein Encoded by Gene No: 88

It has been discovered that this gene is expressed primarily in: amniotic cells induced with TNF in culture; and to a lesser extent in colon tissue from a patient with Crohn's Disease; parathyroid tumor; activated T-cells; cells of the human Caco-2 cell line; adenocarcinoma; colon; corpus colosum; fetal kidney; pancreas tumor; fetal brain; early stage brain, and anergic T-cells.

Therefore, nucleic acids of the invention are useful as reagents for differential identification of the tissue(s) or cell type(s) present in a biological sample and for diagnosis of the following diseases and conditions: tumors. Similarly, polypeptides and antibodies directed to those polypeptides are useful to provide immunological probes for differential identification of the tissue(s) or cell type(s). For a number of disorders of the above tissues or cells, particularly of the immune system; e.g., tumors, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution indicates that the protein product of this clone is useful for modulating tumorigenesis and other immune system conditions such as disorders in immune response. Protein, as well as, antibodies directed against the protein may show utility as a tumor marker and/or immunotherapy targets for the above listed tissues.

Preferred epitopes include those comprising a sequence shown in SEQ ID NO.407 as residues: Pro-61 to Glu-75.

Many polynucleotide sequences, such as EST sequences, are publicly available and accessible through sequence databases. Some of these sequences are related to SEQ ID NO:98 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 490 of SEQ ID NO:98, b is an integer of 15 to 504, where both a and b correspond to the positions of nucleotide residues shown in SEQ ID NO:98, and where the b is greater than or equal to a+14.

Features of Protein Encoded by Gene No: 89

The gene encoding the disclosed cDNA is thought to reside on chromosome 1. Accordingly, polynucleotides related to this invention are useful as a marker in linkage analysis of chromosome 1.

It has been discovered that this gene is expressed primarily in fetal liver/spleen and hematopoietic cells and to a lesser extent in brain, osteosarcoma, and testis tumor.

Therefore, nucleic acids of the invention are useful as reagents for differential identification of the tissue(s) or cell type(s) present in a biological sample and for diagnosis of the following diseases and conditions: leukemia and hematopoietic disorders. Similarly, polypeptides and antibodies directed to those polypeptides are useful to provide immunological probes for differential identification of the tissue(s) or cell type(s). For a number of disorders of the above tissues or cells, particularly of the hematopoietic and immune systems, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for diagnosis and treatment of hematopoietic and immune disorders. Expression of this gene product in hematopoietic cells suggests a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immune deficiency diseases such as AIDS, leukemia, rheumatoid arthritis, inflammatory bowel disease, sepsis, acne, and psoriasis. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Preferred epitopes include those comprising a sequence shown in SEQ ID NO.408 as residues: Gly-13 to Cys-18, Arg-30 to Ser-36, Ala-53 to Phe-58.

Many polynucleotide sequences, such as EST sequences, are publicly available and accessible through sequence databases. Some of these sequences are related to SEQ ID NO:99 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1402 of SEQ ID NO:99, b is an integer of 15 to 1416, where both a and b correspond to the positions of nucleotide residues shown in SEQ ID NO:99, and where the b is greater than or equal to a+14.

Features of Protein Encoded by Gene No: 90

The translation product of this gene shares weak sequence homology with mouse Gcap1 protein which is developmentally regulated in brain. The gene encoding the disclosed cDNA is thought to reside on chromosome 11. Accordingly, polynucleotides of this invention are useful as a marker in linkage analysis for chromosome 11.

It has been discovered that this gene is expressed primarily in infant and adult brain and fetal liver/spleen and to a lesser extent in smooth muscle, T cells, and a variety of other tissues.

Therefore, nucleic acids of the invention are useful as reagents for differential identification of the tissue(s) or cell type(s) present in a biological sample and for diagnosis of the following diseases and conditions: neurological or hematopoietic disorders. Similarly, polypeptides and antibodies directed to those polypeptides are useful to provide immunological probes for differential identification of the tissue(s) or cell type(s). For a number of disorders of the above tissues or cells, particularly of the nervous, hematopoietic, immune, and endocrine systems, expression of this gene at significantly higher or lower levels may be detected in certain tissues (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution and its homology to Gcapl protein suggests that the protein product of this clone would be useful for treating and diagnosis of disorders in neuronal, hematopoietic, immune, and endocrine systems. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:100 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2833 of SEQ ID NO:100, b is an integer of 15 to 2847, where both a and b correspond to the positions of nucleotide residues shown in SEQ ID NO:100, and where the b is greater than or equal to a+14.

Features of Protein Encoded by Gene No: 91

It has been discovered that this gene is expressed primarily in brain and hematopoietic cells and to a lesser extent in tumor tissues.

Therefore, nucleic acids of the invention are useful as reagents for differential identification of the tissue(s) or cell type(s) present in a biological sample and for diagnosis of the following diseases and conditions: disorder in nervous, hematopoietic, immune systems and tumorigenesis. Similarly, polypeptides and antibodies directed to those polypeptides are useful to provide immunological probes for differential identification of the tissue(s) or cell type(s). For a number of disorders of the above tissues or cells, particularly of the in nervous, hematopoietic, immune systems, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution indicates that the protein product of this clone is useful for diagnosis and treatment of disorders in the nervous, hematopoietic, and immune systems. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:101 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1380 of SEQ ID NO:101, b is an integer of 15 to 1394, where both a and b correspond to the positions of nucleotide residues shown in SEQ ID NO:101, and where the b is greater than or equal to a+14.

Features of Protein Encoded by Gene No: 92

The translation product of this gene shares sequence homology with neuroendocrine-specific protein A which is thought to be important in neurologic systems.

It has been discovered that this gene is expressed primarily in brain tissues.

Therefore, nucleic acids of the invention are useful as reagents for differential identification of the tissue(s) or cell type(s) present in a biological sample and for diagnosis of the following diseases and conditions: neural disorders and degeneration disease. Similarly, polypeptides and antibodies directed to those polypeptides are useful to provide immunological probes for differential identification of the tissue(s) or cell type(s). For a number of disorders of the above tissues or cells, particularly of the central or peripheral nervous systems, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution and homology to neuroendocrine-specific protein A suggests that the protein product of this clone would be useful for treatment or diagnosis of neural disorders and degeneration disease. Protein, as well as, antibodies directed against the protein may show utility as a tumor marker and/or immunotherapy targets for the above listed tissues.

Preferred epitopes include those comprising a sequence shown in SEQ ID NO.411 as residues: Glu-65 to Gln-70.

Many polynucleotide sequences, such as EST sequences, are publicly available and a accessible through sequence databases. Some of these sequences are related to SEQ ID NO:102 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 780 of SEQ ID NO:102, b is an 20 integer of 15 to 794, where both a and b correspond to the positions of nucleotide residues shown in SEQ ID NO:102, and where the b is greater than or equal to a+14.

Features of Protein Encoded by Gene No: 93

The translation product of this gene shares sequence homology with collagen-like protein and prolin-rich protein which are thought to be important in connective tissue function and tissue structure.

It has been discovered that this gene is expressed primarily in fetal liver/spleen and brain tissues.

Therefore, nucleic acids of the invention are useful as reagents for differential identification of the tissue(s) or cell type(s) present in a biological sample and for diagnosis of the following diseases and conditions: neuronal or hematopoietic disorders. Similarly, polypeptides and antibodies directed to those polypeptides are useful to provide immunological probes for differential identification of the tissue(s) or cell type(s). For a number of disorders of the above tissues or cells, particularly of the nervous and hematopoietic systems, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution and homology to collagen-like protein and proline-rich proteins suggests that the protein product of this clone would be useful for supporting brain and hematopoietic tissue function and diagnosis and treatment of disorders in these functions. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:103 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1530 of SEQ ID NO:103, b is an integer of 15 to 1544, where both a and b correspond to the positions of nucleotide residues shown in SEQ ID NO:103, and where the b is greater than or equal to a+14.

Features of Protein Encoded by Gene No: 94

It has been discovered that this gene is expressed primarily in embryonic tissues and tumor tissues.

Therefore, nucleic acids of the invention are useful as reagents for differential identification of the tissue(s) or cell type(s) present in a biological sample and for diagnosis of the following diseases and conditions: cancer. Similarly, polypeptides and antibodies directed to those polypeptides are useful to provide immunological probes for differential identification of the tissue(s) or cell type(s). For a number of disorders of the above tissues or cells, particularly of the immune system (e.g., tumors), expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for diagnosis and treatment of cancer. Protein, as well as, antibodies directed against the protein may show utility as a tumor marker and/or immunotherapy targets for the above listed tissues.

Preferred epitopes include those comprising a sequence shown in SEQ ID NO.413 as residues: Pro-39 to Leu-46, Pro-96 to Arg-103, Pro-117 to Ser-124.

Many polynucleotide sequences, such as EST sequences, are publicly available and accessible through sequence databases. Some of these sequences are related to SEQ ID NO:104 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 857 of SEQ ID NO:104, b is an integer of 15 to 871, where both a and b correspond to the positions of nucleotide residues shown in SEQ ID NO:104, and where the b is greater than or equal to a+14.

Features of Protein Encoded by Gene No: 95

It has been discovered that this gene is expressed primarily in brain tumor, placenta,and melanoma.

Therefore, nucleic acids of the invention are useful as reagents for differential identification of the tissue(s) or cell type(s) present in a biological sample and for diagnosis of the following diseases and conditions: brain tumor or melenoma. Similarly, polypeptides and antibodies directed to those polypeptides are useful to provide immunological probes for differential identification of the tissue(s) or cell type(s). For a number of disorders of the above tissues or cells, particularly of the brain or melanocytes, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution indicates that the translation product of this gene is useful in the diagnosis and treatment of brain tumors and melanoma. Protein, as well as, antibodies directed against the protein may show utility as a tumor marker and/or immunotherapy targets for the above listed tissues.

Preferred epitopes include those comprising a sequence shown in SEQ ID NO.414 as residues: Ser-44 to Glu-50, Pro-53 to Gly-60.

Many polynucleotide sequences, such as EST sequences, are publicly available and accessible through sequence databases. Some of these sequences are related to SEQ ID NO:105 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 390 of SEQ ID NO:105, b is an integer of 15 to 404, where both a and b correspond to the positions of nucleotide residues shown in SEQ ID NO:105, and where the b is greater than or equal to a+14.

Features of Protein Encoded by Gene No: 96

The translation product of this gene shares sequence homology with a yeast membrane protein, SUR4, which encodes for APA1 that acts on a glucose-signaling pathway that controls the expression of several genes that are transcriptionally regulated by glucose. The gene encoding the disclosed CDNA is thought to reside on chromosome 1. Accordingly, polynucleotides related to this invention are useful as a marker in linkage analysis for chromosome 1.

It has been discovered that this gene is expressed primarily in fetal liver, and to a lesser extent in placenta and breast tissue.

Therefore, nucleic acids of the invention are useful as reagents for differential identification of the tissue(s) or cell type(s) present in a biological sample and for diagnosis of the following diseases and conditions: defects of fetal liver or defects of glucose-regulated ATPase activitites in tissues. Similarly, polypeptides and antibodies directed to those polypeptides are useful to provide immunological probes for differential identification of the tissue(s) or cell type(s). For a number of disorders of the above tissues or cells, particularly of the fetal immune/hematopoietic system, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution and homology to yeast SUR4 membrane protein suggests that the protein product of this clone would be useful for diagnosis and treatment of defects of fetal liver or defects of glucose-regulated ATPase activitites. Protein, as well as, antibodies directed against the protein may show utility as a tumor marker and/or immunotherapy targets for the above listed tissues.

Preferred epitopes include those comprising a sequence shown in SEQ ID NO.415 as residues: Ala-15 to Gln-20, Tyr-89 to Glu-103, His-253 to Leu-261.

Many polynucleotide sequences, such as EST sequences, are publicly available and accessible through sequence databases. Some of these sequences are related to SEQ ID NO:106 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1528 of SEQ ID NO:106, b is an integer of 15 to 1542, where both a and b correspond to the positions of nucleotide residues shown in SEQ ID NO:106, and where the b is greater than or equal to a+14.

Features of Protein Encoded by Gene No: 97

The gene encoding the disclosed cDNA is thought to reside on chromosome 18. Accordingly, polynucleotides related to the invention are useful as a marker in linkage analysis for chromosome 18.

It has been discovered that this gene is expressed primarily in fetal liver, brain, and amniotic fluid.

Therefore, nucleic acids of the invention are useful as reagents for differential identification of the tissue(s) or cell type(s) present in a biological sample and for diagnosis of the following diseases and conditions: defects of the fetal immune system and adult brain. Similarly, polypeptides and antibodies directed to those polypeptides are useful to provide immunological probes for differential identification of the tissue(s) or cell type(s). For a number of disorders of the above tissues or cells, particularly of the fetal immune system and adult brain, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution indicates that the protein product of this clone is useful for detecting defects of the fetal immune and hematopoietic systems since fetal liver is the predominant organ responsible for hematopoiesis in the fetus. In addition, the gene product of this gene is thought to be useful for detecting certain neurological defects of the brain. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:107 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2313 of SEQ ID NO:107, b is an integer of 15 to 2327, where both a and b correspond to the positions of nucleotide residues shown in SEQ ID NO:107, and where the b is greater than or equal to a+14.

Features of Protein Encoded by Gene No: 98

The translation product of this gene shares sequence homology with an yolk protein precursor, Vitellogenin which is thought to be important in binding lipids such as phosvitin. The gene encoding the disclosed cDNA is thought to reside on chromosome 10. Accordingly, polynucleotides related to the invention are useful as a marker in linkage analysis for chromosome 10.

It has been discovered that this gene is expressed primarily in amnionic cells and fetal liver.

Therefore, nucleic acids of the invention are useful as reagents for differential identification of the tissue(s) or cell type(s) present in a biological sample and for diagnosis of the following diseases and conditions: defects in amnionic cells, fetal liver development and the fetal immune system. Similarly, polypeptides and antibodies directed to those polypeptides are useful to provide immunological probes for differential identification of the tissue(s) or cell type(s). For a number of disorders of the above tissues or cells, particularly of the fetal liver and developing tissues, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution and homology to vitellogenin indicates that the protein product of this clone is useful for treatment and diagnosis of defects in amnionic cells, fetal liver development and the fetal immune system. Protein, as well as, antibodies directed against the protein may show utility as a tumor marker and/or immunotherapy targets for the above listed tissues.

Preferred epitopes include those comprising a sequence shown in SEQ ID NO.417 as residues: Pro-24 to Ala-32.

Many polynucleotide sequences, such as EST sequences, are publicly available and accessible through sequence databases. Some of these sequences are related to SEQ ID NO:108 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1048 of SEQ ID NO:108, b is an integer of 15 to 1062, where both a and b correspond to the positions of nucleotide residues shown in SEQ ID NO:108, and where the b is greater than or equal to a+14.

Features of Protein Encoded by Gene No: 99

It has been discovered that this gene is expressed primarily in placenta, endometrial tumor, osteosarcoma and stromal cells.

Therefore, nucleic acids of the invention are useful as reagents for differential identification of the tissue(s) or cell type(s) present in a biological sample and for diagnosis of the following diseases and conditions: tumor of the endometrium or bone, and osteosarcoma. Similarly, polypeptides and antibodies directed to those polypeptides are useful to provide immunological probes for differential identification of the tissue(s) or cell type(s). For a number of disorders of the above tissues or cells, particularly of the obsteric system (i.g. placenta, endometrium) and the bones, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for diagnosis and treatment of tumors and abnormalities of the endometrium, and the bones because of its abundance in the aforementioned tissues. Protein, as well as, antibodies directed against the protein may show utility as a tumor marker and/or immunotherapy targets for the above listed tissues.

Preferred epitopes include those comprising a sequence shown in SEQ ID NO.418 as residues: Leu-3 to Arg-8, His-11 to Glu-16, Leu-19 to Glu-27, Lys-67 to Glu-73, Tyr-79 to Asp-87, Lys-101 to Ile-107, Val-143 to Leu-155, Thr-162 to Ser-169.

Many polynucleotide sequences, such as EST sequences, are publicly available and accessible through sequence databases. Some of these sequences are related to SEQ ID NO:109 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2525 of SEQ ID NO:109, b is an integer of 15 to 2539, where both a and b correspond to the positions of nucleotide residues shown in SEQ ID NO:109, and where the b is greater than or equal to a+14.

Features of Protein Encoded by Gene No: 100

It has been discovered that this gene is expressed primarily in hepatocellular tumor.

Therefore, nucleic acids of the invention are useful as reagents for differential identification of the tissue(s) or cell type(s) present in a biological sample and for diagnosis of the following diseases and conditions: hepatocellular tumor. Similarly, polypeptides and antibodies directed to those polypeptides are useful to provide immunological probes for differential identification of the tissue(s) or cell type(s). For a number of disorders of the above tissues or cells, particularly of the liver, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution indicates that the protein product of this clone is useful for diagnosis and treatment of hepatocellular cancer because of its abundant expression in this tissue. Protein, as well as, antibodies directed against the protein may show utility as a tumor marker and/or immunotherapy targets for the above listed tissues.

Preferred epitopes include those comprising a sequence shown in SEQ ID NO.419 as residues: Ala-100 to Ser-109, His-138 to His-145, Glu-171 to Ser-182.

Many polynucleotide sequences, such as EST sequences, are publicly available and accessible through sequence databases. Some of these sequences are related to SEQ ID NO:110 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1737 of SEQ ID NO:110, b is an integer of 15 to 1751, where both a and b correspond to the positions of nucleotide residues shown in SEQ ID NO:110, and where the b is greater than or equal to a+14.

Features of Protein Encoded by Gene No: 101

The gene encoding the disclosed cDNA is thought to reside on chromosome 3. Accordingly, polynucleotides related to this invention are useful as a marker in linkage analysis for chromosome 3.

It has been discovered that this gene is expressed primarily in Corpus Colosum, fetal lung and infant brain.

Therefore, nucleic acids of the invention are useful as reagents for differential identification of the tissue(s) or cell type(s) present in a biological sample and for diagnosis of the following diseases and conditions: defects of the Corpus Colosum or defects of the fetal lung. Similarly, polypeptides and antibodies directed to those polypeptides are useful to provide immunological probes for differential identification of the tissue(s) or cell type(s). For a number of disorders of the above tissues or cells, particularly of the Corpus Colosum and brain in general, and fetal lung, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution indicates that the protein product of this clone is useful for diagnosis and treatment of defects of the Corpus Colosum and brain in general, and defects of fetal lung. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:111 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1103 of SEQ ID NO:111, b is an integer of 15 to 1117, where both a and b correspond to the positions of nucleotide residues shown in SEQ ID NO:111, and where the b is greater than or equal to a+14.

Features of Protein Encoded by Gene No: 102

It has been discovered that this gene is expressed primarily in T cells and stromal cells, and to a lesser extent in adrenal gland.

Therefore, nucleic acids of the invention are useful as reagents for differential identification of the tissue(s) or cell type(s) present in a biological sample and for diagnosis of the following diseases and conditions: defects of T cell immunity and stromal cell development. Similarly, polypeptides and antibodies directed to those polypeptides are useful to provide immunological probes for differential identification of the tissue(s) or cell type(s). For a number of disorders of the above tissues or cells, particularly of the immune system, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution indicates that the protein product of this clone is useful for diagnosis and treatment of defects of T cell immunity and stromal cell development because of its abundant expression in these tissues. Protein, as well as, antibodies directed against the protein may show utility as a tumor marker and/or immunotherapy targets for the above listed tissues.

Preferred epitopes include those comprising a sequence shown in SEQ ID NO.421 as residues: Tyr-12 to Glu-17.

Many polynucleotide sequences, such as EST sequences, are publicly available and accessible through sequence databases. Some of these sequences are related to SEQ ID NO:112 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1299 of SEQ ID NO:112, b is an integer of 15 to 1313, where both a and b correspond to the positions of nucleotide residues shown in SEQ ID NO:112, and where the b is greater than or equal to a+14.

Features of Protein Encoded by Gene No: 103

It has been discovered that this gene is expressed primarily in infant brain and placenta.

Therefore, nucleic acids of the invention are useful as reagents for differential identification of the tissue(s) or cell type(s) present in a biological sample and for diagnosis of the following diseases and conditions: defects of the brain and nervous system. Similarly, polypeptides and antibodies directed to those polypeptides are useful to provide immunological probes for differential identification of the tissue(s) or cell type(s). For a number of disorders of the above tissues or cells, particularly of the nervous system, especially brain, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution indicates that the protein product of this clone is useful for detecting defects of the brain, especially in young children. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:113 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1640 of SEQ ID NO:113, b is an integer of 15 to 1654, where both a and b correspond to the positions of nucleotide residues shown in SEQ ID NO:113, and where the b is greater than or equal to a+14.

Features of Protein Encoded by Gene No: 105

It has been discovered that this gene is expressed primarily in human osteoclastoma and to a lesser extent in human pancreas tumor.

Therefore, nucleic acids of the invention are useful as reagents for differential identification of the tissue(s) or cell type(s) present in a biological sample and for diagnosis of the following diseases and conditions: cancer, particularly osteoclastoma and pancreatic tumor. Similarly, polypeptides and antibodies directed to those polypeptides are useful to provide immunological probes for differential identification of the tissue(s) or cell type(s). For a number of disorders of the above tissues or cells, particularly in transformed tissues, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution indicates that the protein product of this clone is useful for diagnosis and treatment of some types of tumors, particularly pancreatic cancer and osteoclastoma. Protein, as well as, antibodies directed against the protein may show utility as a tumor marker and/or immunotherapy targets for the above listed tissues.

Preferred epitopes include those comprising a sequence shown in SEQ ID NO.424 as residues: Glu-17 to Leu-23, Ala-148 to Leu-173.

Many polynucleotide sequences, such as EST sequences, are publicly available and accessible through sequence databases. Some of these sequences are related to SEQ ID NO:115 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 828 of SEQ ID NO:115, b is an integer of 15 to 842, where both a and b correspond to the positions of nucleotide residues shown in SEQ ID NO:115, and where the b is greater than or equal to a+14.

Features of Protein Encoded by Gene No: 106

The gene encoding the disclosed cDNA is thought to reside on chromosome 1. Accordingly, polynucleotides related to this invention are useful as a marker in linkage analysis for chromosome I 1.

It has been discovered that this gene is expressed primarily in fetal liver/spleen, and to a lesser extent in activated T-Cells, 8 hrs.

Therefore, nucleic acids of the invention are useful as reagents for differential identification of the tissue(s) or cell type(s) present in a biological sample and for diagnosis of the following diseases and conditions: immune disorders. Similarly, polypeptides and antibodies directed to those polypeptides are useful to provide immunological probes for differential identification of the tissue(s) or cell type(s). For a number of disorders of the above tissues or cells, particularly of the immune system, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for diagnosis or treatment of immune disorders. Protein, as well as, antibodies directed against the protein may show utility as a tumor marker and/or immunotherapy targets for the above listed tissues.

Preferred epitopes include those comprising a sequence shown in SEQ ID NO.425 as residues: Leu-31 to Lys-37.

Many pelynucleotide sequences, such as EST sequences, are publicly available and accessible through sequence databases. Some of these sequences are related to SEQ ID NO:116 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1626 of SEQ ID NO:116, b is an integer of 15 to 1640, where both a and b correspond to the positions of nucleotide residues shown in SEQ ID NO:116, and where the b is greater than or equal to a+14.

Features of Protein Encoded by Gene No: 107

It has been discovered that this gene is expressed primarily in human embryo and to a lesser extent in spleen and chronic lymphocytic leukemia.

Therefore, nucleic acids of the invention are useful as reagents for differential identification of the tissue(s) or cell type(s) present in a biological sample and for diagnosis of the following diseases and conditions: leukemia. Similarly, polypeptides and antibodies directed to those polypeptides are useful to provide immunological probes for differential identification of the tissue(s) or cell type(s). For a number of disorders of the above tissues or cells, particularly of the immune or hemopoietic systems, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution indicates that the protein product of this clone is useful for the diagnosis and treatment of leukemia. Protein, as well as, antibodies directed against the protein may show utility as a tumor marker and/or immunotherapy targets for the above listed tissues.

Preferred epitopes include those comprising a sequence shown in SEQ ID NO.426 as residues: Gly-26 to Asn-31, Glu-53 to Gly-62.

Many polynucleotide sequences, such as EST sequences, are publicly available and accessible through sequence databases. Some of these sequences are related to SEQ ID NO:117 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 938 of SEQ ID NO:117, b is an integer of 15 to 952, where both a and b correspond to the positions of nucleotide residues shown in SEQ ID NO:117, and where the b is greater than or equal to a+14.

Features of Protein Encoded by Gene No: 108

The gene encoding the disclosed cDNA is thought to reside on chromosome 17. Accordingly, polynucleotides related to this invention are useful as a marker in linkage analysis for chromosome 17.

It has been discovered that this gene is expressed primarily in placenta, and to a lesser extent in early stage human brain and in lung.

Therefore, nucleic acids of the invention are useful as reagents for differential identification of the tissue(s) or cell type(s) present in a biological sample and for diagnosis of the following diseases and conditions: fetal developmental abnormalities. Similarly, polypeptides and antibodies directed to those polypeptides are useful to provide immunological probes for differential identification of the tissue(s) or cell type(s). For a number of disorders of the above tissues or cells, particularly in fetal and amniotic tissue, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution indicates that the protein product of this is useful for production of growth factor(s) associated with fetal development. Preferred polypeptides comprise the full-length polypeptide shown in the sequence listing, truncated however, at the amino terminus and beginning with QTIE. Protein, as well as, antibodies directed against the protein may show utility as a tumor marker and/or immunotherapy targets for the above listed tissues.

Preferred epitopes include those comprising a sequence shown in SEQ ID NO.427 as residues: Pro-12 to Gly-22, Ile-57 to Cys-63, Leu-87 to Met-96, Ala-109 to Gln-118, Glu-144 to Phe-150.

Many polynucleotide sequences, such as EST sequences, are publicly available and accessible through sequence databases. Some of these sequences are related to SEQ ID NO:118 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1242 of SEQ ID NO:118, b is an integer of 15 to 1256, where both a and b correspond to the positions of nucleotide residues shown in SEQ ID NO:118, and where the b is greater than or equal to a+14.

Features of Protein Encoded by Gene No: 109

The gene encoding the disclosed cDNA is thought to reside on chromosome 2. Accordingly, polynucleotides related to this invention are useful as a marker in linkage analysis for chromosome 2.

It has been discovered that this gene is expressed primarily in fetal spleen, and to a lesser extent in B-Cell lymphoma and T-Cell lymphoma.

Therefore, nucleic acids of the invention are useful as reagents for differential identification of the tissue(s) or cell type(s) present in a biological sample and for diagnosis of the following diseases and conditions: lymphoma. Similarly, polypeptides and antibodies directed to those polypeptides are useful to provide immunological probes for differential identification of the tissue(s) or cell type(s). For a number of disorders of the above tissues or cells, particularly of the immune system, expression of this gene at significantly higher or lower levels may be detected in certain tissues (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution indicates that the protein product of this clone is useful for the treatment and diagnosis of human lymphomas. Protein, as well as, antibodies directed against the protein may show utility as a tumor marker and/or immunotherapy targets for the above listed tissues.

Preferred epitopes include those comprising a sequence shown in SEQ ID NO.428 as residues: Glu-9 to Arg-15, Pro-71 to Lys-79.

Many polynucleotide sequences, such as EST sequences, are publicly available and accessible through sequence databases. Some of these sequences are related to SEQ ID NO:119 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1129 of SEQ ID NO:119, b is an integer of 15 to 1143, where both a and b correspond to the positions of nucleotide residues shown in SEQ ID NO:119, and where the b is greater than or equal to a+14.

Features of Protein Encoded by Gene No: 110

The translation product of this gene shares sequence homology with sarcoma amplified sequence (SAS), a tetraspan receptor which is thought to be important in malignant fibrous histiocytoma and liposarcoma. The translation product of this clone also shares sequence homology with Transmembrane 4 superfamily proteins. The transmembrane 4 superfamily (TM4SF), or tetraspan superfamily, is the second biggestsubfamily among CD antigen superfamilies. Members of this family appear to serve a role in the activation of T-cells, for example as an activation antigen of T-cells. All TM4SF members contain four putative transmembrane domains, two extracellular loops, and two short cytoplasmic tails. One embodiment of this clone comprises polypeptides of the following amino acid sequence: GPG-PPPTSALLPRLGXAPKARTKQLSGNLRRS RIYVQL-PATTGSKMVCGGFACSKNCLCALN-LLYTLVSLLLIGIAAWGIGFGLISSLRVVGV VIAVGIFLFLIALVGLIGAVKHHQVLLFFY (SEQ ID NO:693). An additional embodiment would be the polynucleotides encoding these polypeptides.

It has been discovered that this gene is expressed primarily in human osteoclastoma, and to a lesser extent in pineal gland and infant brain.

Therefore, nucleic acids of the invention are useful as reagents for differential identification of the tissue(s) or cell type(s) present in a biological sample and for diagnosis of the following diseases and conditions: malignant fibrous histiocytoma and liposarcoma. Similarly, polypeptides and antibodies directed to those polypeptides are useful to provide immunological probes for differential identification of the tissue(s) or cell type(s). For a number of disorders of the above tissues or cells, particularly of the immune system, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution and homology to sarcoma amplified sequence (SAS) indicates that the protein product of this clone is useful for treatment of, osteosarcoma, malignant fibrous histiocytoma and liposarcoma and related cancers, particularly sarcomas. Alternatively,the homology to TM4SF proteins indicates that the translation product of this clone may function as an activating agent of T-cells and their immune response in the body. Protein, as well as, antibodies directed against the protein may show utility as a tumor marker and/or immunotherapy targets for the above listed tissues.

Preferred epitopes include those comprising a sequence shown in SEQ ID NO.429 as residues: Asn-100 to Gly-105, Asn-l 14 to Leu-126, Ser-133 to Thr-139, Lys-146 to Cys-151, Tyr-188 to Pro-200.

Many polynucleotide sequences, such as EST sequences, are publicly available and accessible through sequence databases. Some of these sequences are related to SEQ ID NO:120 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1768 of SEQ ID NO:120, b is an integer of 15 to 1782, where both a and b correspond to the positions of nucleotide residues shown in SEQ ID NO:120, and where the b is greater than or equal to a+14.

Features of Protein Encoded by Gene No: 111

The translation product of this gene shares sequence homology with 6.8K proteolipid protein, mitochondrial—bovine.

It has been discovered that this gene is expressed primarily in wilm's tumor and to a lesser extent in cerebellum and placenta.

Therefore, nucleic acids of the invention are useful as reagents for differential identification of the tissue(s) or cell type(s) present in a biological sample and for diagnosis of the following diseases and conditions: wini's tumor. Similarly, polypeptides and antibodies directed to those polypeptides are useful to provide immunological probes for differential identification of the tissue(s) or cell type(s). For a number of disorders of the above tissues or cells, particularly of the immune or renal systems, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution and homology to 6.8K proteolipid protein indicates that the protein product of this clone is useful for diagnostic and therapeutics associated with tumors, particularly wilm's tumor disease. Protein, as well as, antibodies directed against the protein may show utility as a tumor marker and/or immunotherapy targets for the above listed tissues.

Preferred epitopes include those comprising a sequence shown in SEQ ID NO.430 as residues: Asp-42 to Ala-47.

Many polynucleotide sequences, such as EST sequences, are publicly available and accessible through sequence databases. Some of these sequences are related to SEQ ID NO:121 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 596 of SEQ ID NO:121, b is an integer of 15 to 610, where both a and b correspond to the positions of nucleotide residues shown in SEQ ID NO:121, and where the b is greater than or equal to a+14.

Features of Protein Encoded by Gene No: 112

It has been discovered that this gene is expressed primarily in embryonic tissue and to a lesser extent in osteoblasts, endothelial cells, macrophages (GM-CSF treated), and bone marrow.

Therefore, nucleic acids of the invention are useful as reagents for differential identification of the tissue(s) or cell type(s) present in a biological sample and for diagnosis of the following diseases and conditions: immune disorders. Similarly, polypeptides and antibodies directed to those polypeptides are useful to provide immunological probes for differential identification of the tissue(s) or cell type(s). For a number of disorders of the above tissues or cells, particularly of the immune system, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for treatment or diagnosis of immune disorders. Expression of this gene product in immune cells suggests a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immune deficiency diseases such as AIDS, leukemia, rheumatoid arthritis, inflammatory bowel disease, sepsis, acne, and psoriasis. In addition, this gene product may have commercial utility in the expansion of stem cells and committed progenitors of various blood lineages, and in the differentiation and/or proliferation of various cell types. Protein, as well as, antibodies directed against the protein may show utility as a tissue-specific marker and/or immunotherapy target for the above listed tissues. Preferred polypeptides encoded by this gene comprise the following amino acid sequence: MITD-VQLAIFANMLGVSLFLLVVLYHYVAVNNPKKQE (SEQ ID NO: 694).

Preferred epitopes include those comprising a sequence shown in SEQ ID NO. 431 as residues: Asn-20 to Glu-25.

Many polynucleotide sequences, such as EST sequences, are publicly available and accessible through sequence databases. Some of these sequences are related to SEQ ID NO:122 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 512 of SEQ ID NO:122, b is an integer of 15 to 526, where both a and b correspond to the positions of nucleotide residues shown in SEQ ID NO:122, and where the b is greater than or equal to a+14.

Features of Protein Encoded by Gene No: 113

The gene encoding the disclosed cDNA is thought to reside on chromosome 5. Accordingly, polynucleotides related to this invention are useful as a marker in linkage analysis for chromosome 5.

It has been discovered that this gene is expressed primarily in hepatocellular tumor, and to a lesser extent in fetal liver/spleen.

Therefore, nucleic acids of the invention are useful as reagents for differential identification of the tissue(s) or cell type(s) present in a biological sample and for diagnosis of the following diseases and conditions: tumors, particularly hepatocellular tumors. Similarly, polypeptides and antibodies directed to those polypeptides are useful to provide immunological probes for differential identification of the tissue(s) or cell type(s). For a number of disorders of the above tissues or cells, particularly of the hepatic system, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution indicates that the protein product of this clone is useful for diagnosis and treatment of tumors, particularly hepatocellular tumors. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:123 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2067 of SEQ ID NO:123, b is an integer of 15 to 2081, where both a and b correspond to the positions of nucleotide residues shown in SEQ ID NO:123, and where the b is greater than or equal to a+14.

Features of Protein Encoded by Gene No: 114

The translation product of this gene exhibits a very high degree of sequence identity with the human Pig8 gene which is thought to be important in p53 mediated apoptosis. The sequence of this gene has since been published by Polyak and colleagues (Nature 389, 300–306 (1997)). In addition, the predicted translation product of this contig exhibits very high sequence homology with a murine gene denoted as E124 which is also thought to be important in p53 mediated apoptosis.

It has been discovered that this gene is expressed primarily in infant brain and activated T-cells and to a lesser extent in bone marrow, fetal liver, and prostate.

Therefore, nucleic acids of the invention are useful as reagents for differential identification of the tissue(s) or cell type(s) present in a biological sample and for diagnosis of the following diseases and conditions: cancer and tissue damage by radiation and anti-cancer drugs. Similarly, polypeptides and antibodies directed to those polypeptides are useful to provide immunological probes for differential identification of the tissue(s) or cell type(s). For a number of disorders of the above tissues or cells, particularly of the nervous and immune systems, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution and homology to human Pig8 and murine E124 genes suggests that the protein product of this clone would be useful for preventing apoptosis in patients being treated with anti-oncogenic drugs such as etoposide, hydroperoxycyclophosphamide, and X-irradiation, since this protein product is upregulated in cells undergoing such treatment where p53 was overexpressed. It may also be useful in the treatment of hematopoietic disorders and in boosting numbers of hematopoietic stem cells by interfering with the apoptosis of progenitor cells. The mature polypeptide is predicted to comprise the following amino acid sequence: EEMADSVKTFLQDLARGIKD SIWGIC-TISKLD ARIQQKREEQRRRRASSVLAQR-RAQSIERKQESEPRIVSRIFQCCAWNGG VFWFSLLL-FYRVFIPVLQSVTARIIIGDPSLHGDVWSWLEFFLTSI FSALWVLPLFVLSKVVN AIWFQDIADLAFEVSGRK- PHPFPSVSKIIADMLFNLLLQALFLIQG-
MFVSLFPIHLVGQLVS LLHMSLLYSLYCFEYRW-
FNKGIEMHQRLSNIERNWPYYFGFGLPLAFLTAMQ
SSYIISGC LFSLFPLFIISANEAKTPGKAYLFQLR-
LFSLVVFLSNRLFHKTVYLQSALSSSTSAEKFPSP
HPSPAKLKATAGH (SEQ ID NO: 695). Accordingly, polypeptides comprising the foregoing amino acid sequence are provided as are polynucleotides encoded such polypeptides. Protein, as well as, antibodies directed against the protein may show utility as a tumor marker and/or immunotherapy targets for the above listed tissues.

Preferred epitopes include those comprising a sequence shown in SEQ ID NO. 433 as residues: Asn-24 to Gly-30, Thr-65 to Ala-78.

Many polynucleotide sequences, such as EST sequences, are publicly available and accessible through sequence databases. Some of these sequences are related to SEQ ID NO:124 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1703 of SEQ ID NO:124, b is an integer of 15 to 1717, where both a and b correspond to the positions of nucleotide residues shown in SEQ ID NO:124, and where the b is greater than or equal to a+14.

Features of Protein Encoded by Gene No: 115

It has been discovered that this gene is expressed primarily in stromal cells and to a lesser extent in multiple sclerosis.

Therefore, nucleic acids of the invention are useful as reagents for differential identification of the tissue(s) or cell type(s) present in a biological sample and for diagnosis of the following diseases and conditions: affecting the nervous system. Similarly, polypeptides and antibodies directed to those polypeptides are useful to provide immunological probes for differential identification of the tissue(s) or cell type(s). For a number of disorders of the above tissues or cells, particularly of the nervous system, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for treatment and diagnosis of multiple sclerosis and other autoimmune diseases. Protein, as well as, antibodies directed against the protein may show utility as a tumor marker and/or immunotherapy targets for the above listed tissues.

Preferred epitopes include those comprising a sequence shown in SEQ ID NO.434 as residues: Pro-28 to Ile-33, Lys-88 to Ser-93, Glu-182 to Pro-192.

Many polynucleotide sequences, such as EST sequences, are publicly available and accessible through sequence databases. Some of these sequences are related to SEQ ID NO:125 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 790 of SEQ ID NO:125, b is an integer of 15 to 804, where both a and b correspond to the positions of nucleotide residues shown in SEQ ID NO:125, and where the b is greater than or equal to a+14.

Features of Protein Encoded by Gene No: 116

It has been discovered that this gene is expressed primarily in the gall bladder.

Therefore, nucleic acids of the invention are useful as reagents for differential identification of the tissue(s) or cell type(s) present in a biological sample and for diagnosis of the following diseases and conditions: gall stones or infection of the digestive system. Similarly, polypeptides and antibodies directed to those polypeptides are useful to provide immunological probes for .- differential identification of the tissue(s) or cell type(s). For a number of disorders of the above tissues or cells, particularly of the digestive system or renal system, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for possible prevention of digestive disorders where there may be a lack of digestive enzymes produced or in the detection and possible prevention of gall stones. Protein, as well as, antibodies directed against the protein may show utility as a tumor marker and/or immunotherapy targets for the above listed tissues.

Preferred epitopes include those comprising a sequence shown in SEQ ID NO. 435 as residues: Lys-32 to Val-37.

Many polynucleotide sequences, such as EST sequences, are publicly available and accessible through sequence databases. Some of these sequences are related to SEQ ID NO:126 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 417 of SEQ ID NO:126, b is an integer of 15 to 431, where both a and b correspond to the positions of nucleotide residues shown in SEQ ID NO:126, and where the b is greater than or equal to a+14.

Features of Protein Encoded by Gene No: 117

The translation product of this gene shares sequence homology with the dystrophin gene which is thought to be important in the building and maintenance of muscles. The gene encoding the disclosed cDNA is thought to reside on chromosome 1. Accordingly, polynucleotides related to this invention are useful as a marker in linkage analysis for chromosome 1.

It has been discovered that this gene is expressed primarily in placenta and to a lesser extent in fetal brain and fetal liver spleen.

Therefore, nucleic acids of the invention are useful as reagents for differential identification of the tissue(s) or cell type(s) present in a biological sample and for diagnosis of the following diseases and conditions: muscular dystropy, Duchenne and Becker's muscular dystropies. Similarly, polypeptides and antibodies directed to those polypeptides are useful to provide immunological probes for differential identification of the tissue(s) or cell type(s). For a number of disorders of the above tissues or cells, particularly of the skeletal muscle system, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution and homology to the dystrophin gene suggests that the protein product of this clone would be useful for diseases related the degenerative myopathies that are characterized by the weakness and atrophy of muscles without neural degradation; such as Duchenne and Becker's muscular dystropies. Protein, as well as, antibodies directed against the protein may show utility as a tumor marker and/or immunotherapy targets for the above listed tissues.

Preferred epitopes include those comprising a sequence shown in SEQ ID NO. 436 as residues: Lys-2 to Val-9, Lys-52 to Leu-58, Gln-88 to Asp-99, Met-115 to Val-122, Arg-124 to Glu-135, Glu-143 to Pro-1 59, Ser-167 to Ile-174, Glu-190 to Leu-195, Arg-237 to Arg-248, Asp-275 to Tyr-281, Pro-293 to Glu-308, Ile-329 to Arg-335, Gln-341 to Gln-347, Arg-355 to Trp-362.

Many polynucleotide sequences, such as EST sequences, are publicly available and accessible through sequence databases. Some of these sequences are related to SEQ ID NO:127 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 3738 of SEQ ID NO:127, b is an integer of 15 to 3752, where both a and b correspond to the positions of nucleotide residues shown in SEQ ID NO:127, and where the b is greater than or equal to a+14.

Features of Protein Encoded by Gene No: 118

The gene encoding the disclosed cDNA is thought to reside on chromosome 2. Accordingly, polynucleotides related to this invention are useful as a marker in linkage analysis for chromosome 2.

It has been discovered that this gene is expressed primarily in olfactory and to a lesser extent in cartridge.

Therefore, nucleic acids of the invention are useful as reagents for differential identification of the tissue(s) or cell type(s) present in a biological sample and for diagnosis of the following diseases and conditions: connective tissue diseases; chondrosarcomas. Similarly, polypeptides and antibodies directed to those polypeptides are useful to provide immunological probes for differential identification of the tissue(s) or cell type(s). For a number of disorders of the above tissues or cells, particularly of the connective tissue, expression of this gene at significantly higher or lower levels may be detected in certain tissues (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution and suggests that the protein product of this clone would be useful for tumors of connective tissues, osteoarthritis and the treatment and diagnosis of chondrosarcoma. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:128 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1130 of SEQ ID NO:128, b is an integer of 15 to 1144, where both a and b correspond to the positions of nucleotide residues shown in SEQ ID NO:128, and where the b is greater than or equal to a+14.

Features of Protein Encoded by Gene No: 119

The gene encoding the disclosed CDNA is thought to reside on chromosome 20. Accordingly, polynucleotides related to this invention are useful as a marker in linkage analysis for chromosome 20.

It has been discovered that this gene is expressed primarily in Activated Neutrophils and to a lesser extent in fetal spleen, and CD34 positive cells from cord blood.

Therefore, nucleic acids of the invention are useful as reagents for differential identification of the tissue(s) or cell type(s) present in a biological sample and for diagnosis of the following diseases and conditions: allergies, defects in hematopoesis and inflammation. Similarly, polypeptides and antibodies directed to those polypeptides are useful to provide immunological probes for differential identification of the tissue(s) or cell type(s). For a number of disorders of the above tissues or cells, particularly of the immune system and hematopoesis system the, expression of this gene at significantly higher or lower levels may be detected in certain tissues (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for reducing the allergic effects felt by allergy suffers by neutralizing the activity of the immune system, especially since neutrophils are abundant in persons suffering from allergies and other inflammatory conditions. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:129 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1816 of SEQ ID NO:129, b is an integer of 15 to 1830, where both a and b correspond to the positions of nucleotide residues shown in SEQ ID NO:129, and where the b is greater than or equal to a+14.

Features of Protein Encoded by Gene No: 120

The translation product of this gene shares sequence homology with poly A binding protein II which is thought to be important in RNA binding for transcription of RNA to DNA. In specific embodiments, polypeptides of the invention comprise the following amino acid sequence: MATPASAPDTRALVADFVGYKLRQKGYVCGAGPGE GPAADPLHQAMRAAGDEFETRFRRTFSDLAAQLHVTPGSAQQRFTQVSDELFQGGPNWG RLVAFFVFGAALCAESVNKEMEPLVGQVQEWMVAYLETRLADWIHSSGG WLSQITE-AEMADEVICSEILSDCDSAASSPDLEE-LEAIKRVREMEEEAEKLKELQNEVEKQ MNMSPPPGNAGPVIMSIEEKMEADAR-SIYVGNVDYGATAEELEAHFHGCG SVNRVTILCDKF-SGHPKGFAYIEFSDKESVRTSLA-LDESLFRGRQIKVIPKRTNRPGISTTD RGFPRARYRARTTNYNSSRSRFYSGFN-SRPRGRVYRGRARATSWYSPY (SEQ ID NO: 696), VEKQMNMSPPPGNAGPVIMSIEEKM (SEQ ID NO:697), ELEAIKARVRC (SEQ ID NO:698), VDYGA-TAEELEAHFHGCGSVNRVTILCDKFSG HP (SEQ ID NO:699), or ALDESLFRGRQIKVIPKRTNRPGISTTDRG (SEQ ID NO:700). Polynucleotides encoding these polypeptides are also encompassed by the invention.

This gene is expressed primarily in colon and to a lesser extent in brain and immune system.

Therefore, polynucleotides and polypeptides of the invention are useful as reagents for differential identification of the tissue(s) or cell type(s) present in a biological sample and for diagnosis of diseases and conditions: colon cancer. Similarly, polypeptides and antibodies directed to these polypeptides are useful in providing immunological probes for differential identification of the tissue(s) or cell type(s). For a number of disorders of the above tissues or cells, particularly of the immune and digestive system, expression of this gene at significantly higher or lower levels may be routinely detected in certain tissues and cell types (e.g., colon, tissue and cells of the immune system, and brain or other tissue of the nervous system, and cancerous and wounded tissues) or bodily fluids (e.g. lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to poly A binding protein II indicate that polynucleotides and polypeptides corresponding to this gene are useful for detection and treatment of colon cancer and other disorders of the digestive system. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:130 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1850 of SEQ ID NO:130, b is an integer of 15 to 1864, where both a and b correspond to the positions of nucleotide residues shown in SEQ ID NO:130, and where the b is greater than or equal to a+14.

Features of Protein Encoded by Gene No: 121

The translation product of this gene shares sequence homology with thymidine diphosphoglucose 4.6 dehydrase which is thought to be important in the metabolism of sugar. In specific embodiments, polypeptides of the invention comprise the following amino acid sequence: PRRVE-PLYIEVDQIYHLASPASPPNYMYNPIKTLKTNTIGT LNMLGLAKRVGARLLLASTSEVYGDPE-VHPQSEDYWGHVNPIGPRACYDEGKRV AETM-CYAYMKQEGVEVRVAR GPRM MNDGRVVSN-FLQALQGEPLTVYG SGSQTRAFQYVSDLVNGLVALMNSN-VSSPVNLGNPEEHTILEFAQLIKNLVGSG SEIQ-FLSEAQDDPQKRKPDIKKAKLMLGWEPV-VPLEEGLNKAIHYFRKELEYQANNQYIP KPKPARIKKGRTRHS (SEQ ID NO:701), MLGLAKRV-GAR (SEQ ID NO:702), LLASTSEVYGDP (SEQ ID NO:703), IGPRACYDEGKRVAET (SEQ ID NO:704), RVARIFNT (SEQ ID NO:705), or NDGRVVSNFI (SEQ ID NO:706). Polynucleotides encoding these polypeptides are also encompassed by the invention. The gene encoding the disclosed cDNA is believed to reside on chromosome 2. Accordingly, polynucleotides related to this invention are useful as a marker in linkage analysis for chromosome 2.

This gene is expressed primarily in fetal liver and spleen and to a lesser extent in infant brain.

Therefore, polynucleotides and polypeptides of the invention are useful as reagents for differential identification of the tissue(s) or cell type(s) present in a biological sample and for diagnosis of diseases and conditions: diabetes. Similarly, polypeptides and antibodies directed to these polypeptides are useful in providing immunological probes for differential identification of the tissue(s) or cell type(s). For a number of disorders of the above tissues or cells, particularly of the endocrine system, expression of this gene at significantly higher or lower levels may be routinely detected in certain tissues and cell types (e.g., liver, spleen, and brain and other tissue of the nervous system, and cancerous and wounded tissues) or bodily fluids (e.g. bile, amniotic fluid, lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to thymidine diphospoglucose 4.6 dehydrase indicate that polynucleotides and polypeptides corresponding to this gene are useful for treatment of persons with diabetes since it appears that this protein is needed in the metabolism of sugar to its more basic components. Alternatively, expression within fetal tissues and other cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Preferred epitopes include those comprising a sequence shown in SEQ ID NO.440 as residues: Ser-42 to Gly-47, Leu-62 to Pro-79, Ser-84 to Lys-89, Phe-122 to Asn-128, Pro-148 to Thr-154.

Many polynucleotide sequences, such as EST sequences, are publicly available and accessible through sequence databases. Some of these sequences are related to SEQ ID NO:131 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2027 of SEQ ID NO:131, b is an integer of 15 to 2041, where both a and b correspond to the positions of nucleotide residues shown in SEQ ID NO:131, and where the b is greater than or equal to a+14.

Features of Protein Encoded by Gene No: 122

The translation product of this gene shares sequence homology with ceruloplasmin which is thought to be important in the metabolism and transport of iron and copper. Ceruloplasmin also contains domains with homology to clotting factors V and VIII. Defects in the circulating levels of ceruloplasmin (aceruloplasminemia) have been associated with certain disease conditions such as Wilson disease, and the accompanying hepatolenticular degeneration. In specific embodiments, polypeptides of the invention comprise the following amino acid sequence: YQAARIYYI-MAEEVEWDYCPDRSWEREWH-NQSEKDSYGYIFLSNKDGLLGSRYKKAVFR EYTDGTFRXPRPRTGPEEHLGILGPLIK-GEVGDILTVVFKNNASRPYSVHAHGVLESTTV WPLAAEPGEVVTYQWNIPERSGPGP-MTLLVFPGSILQWIPSRTCIVAWWGPWLSAKRAS WXPHGGRXDMDREFALLFLIFDENKSW-YLEENVATHGSQDPGSINLQDETFLESNKMHA INGK-LYANLRGLTMYQGERVAWYMLAMGQDVDLHT SFLYRNGENYRADVVDL FPGTFEVVEMVASN-PGTWLMHCHVTDHVHAGMETLFTVFS-RTEHLSPLTVITKETEKAV PPRDIEEGNVKMLGMQIP-IKNVEMLASVLVAISVTLLLVVLALGGVVWYQHRQ RKLRRN RRSILDDSFKLLSFKQ (SEQ ID NO:707), or GGHLSVEHPREVWP-WANDSACVSWIYYSAVDPIKDMYSGLVGPLA ICQKGILXAPWRT (SEQ ID NO:708). Polynucleotides encoding these polypeptides are also encompassed by the invention.

This gene is expressed primarily in brain and retina and to a lesser extent in endothelial cells.

Therefore, polynucleotides and polypeptides of the invention are useful as reagents for differential identification of the tissue(s) or cell type(s) present in a biological sample and for diagnosis of diseases and conditions: diseases marked by defects in iron metabolism; aceruloplasminemia not characterized by defects in the known ceruloplasmin gene locus; nonclassical Wilson disease; movement disorders; and tumors derived from a brain tissue origin. Similarly, polypeptides and antibodies directed to these polypeptides are useful in providing immunological probes for differential identification of the tissue(s) or cell type(s). For a number of disorders of the above tissues or cells, particularly of the brain, retina, and nervous system, expression of this gene at significantly higher or lower levels may be routinely detected in certain tissues and cell types (e.g., brain and other tissue of the nervous system, retinal tissue, and endothelial cells, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to ceruloplasmin indicate that polynucleotides and polypeptides corresponding to this gene are useful for treatment of patients with aceruloplasminemia, or other defects in iron and/or copper metabolism. Mutations in this locus could also be diagnostic for patients currently experiencing or predicted to experience aceruloplasminemia. Protein, as well as, antibodies directed against the protein may show utility as a tumor marker and/or immunotherapy targets for the above listed tissues.

Preferred epitopes include those comprising a sequence shown in SEQ ID NO.441 as residues: Asn-30 to Asp-37.

Many polynucleotide sequences, such as EST sequences, are publicly available and accessible through sequence databases. Some of these sequences are related to SEQ ID NO:132 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1998 of SEQ ID NO:132, b is an integer of 15 to 2012, where both a and b correspond to the positions of nucleotide residues shown in SEQ ID NO:132, and where the b is greater than or equal to a+14.

Features of Protein Encoded by Gene No: 123

The gene encoding the disclosed cDNA is believed to reside on chromosome 9. Accordingly, polynucleotides related to this invention are useful as a marker in linkage analysis for chromosome 9.

This gene is expressed primarily in brain and B cell lymphoma and to a lesser extent in fetal liver and spleen.

Therefore, polynucleotides and polypeptides of the invention are useful as reagents for differential identification of the tissue(s) or cell type(s) present in a biological sample and for diagnosis of diseases and conditions: immune, or developmental disorders, particularly B cell lymphoma; tumors and diseases of the brain and/or spleen; hematopoietic defects. Similarly, polypeptides and antibodies directed to these polypeptides are useful in providing immunological probes for differential identification of the tissue(s) or cell type(s). For a number of disorders of the above tissues or cells, particularly of the brain and hematopoietic system, expression of this gene at significantly higher or lower levels may be routinely detected in certain tissues and cell types (e.g., brain and other tissue of the nervous system, blood cells, liver, and spleen, and cancerous and wounded tissues) or bodily fluids (e.g. lymph, amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for treatment of disorders in neuronal, hematopoietic, and immune systems. It could potentially be useful for neurodegenerative disorders and neuronal and/or hematopoietic cell survival or proliferation. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:133 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1655 of SEQ ID NO:133, b is an integer of 15 to 1669, where both a and b correspond to the positions of nucleotide residues shown in SEQ ID NO:133, and where the b is greater than or equal to a+14.

Features of Protein Encoded by Gene No: 124

Polynucleotides of the invention do not comprise the nucleic acid sequence shown as Genbank Accession No. gb|G20858|G20858, which is hereby incorporated herein by reference.

This gene is expressed primarily in osteoclastoma, dermatofibrosarcoma, and B cell lymphoma and to a lesser extent in endothelial cells.

Therefore, polynucleotides and polypeptides of the invention are useful as reagents for differential identification of the tissue(s) or cell type(s) present in a biological sample and for diagnosis of diseases and conditions which include, but are not limited to, cancers, in particular osteoclastoma, dermatofibrosarcoma, and B cell lymphoma. Similarly, polypeptides and antibodies directed to these polypeptides are useful in providing immunological probes for differential identification of the tissue(s) or cell type(s). For a number of disorders of the above tissues or cells, particularly of the bone, immune, and circulatory system, expression of this gene at significantly higher or lower levels may be routinely detected in certain tissues and cell types (e.g., bone, epidermis, blood cells, muscle, immune, and endothelial cells, and cancerous and wounded tissues) or bodily fluids (e.g. lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for diagnosis and treatment of cancers and lymphoma; osteoporosis; and the control of cell proliferation and/or differentiation. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:134 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1551 of SEQ ID NO:134, b is an integer of 15 to 1565, where both a and b correspond to the positions of nucleotide residues shown in SEQ ID NO:134, and where the b is greater than or equal to a+14.

Features of Protein Encoded by Gene No: 125

This gene is expressed primarily in immune tissues and hematopoietic cells, particularly in activated T cells and neutrophils, spleen, and fetal liver, and to a lesser extent in infant adrenal gland.

Therefore, polynucleotides and polypeptides of the invention are useful as reagents for differential identification of the tissue(s) or cell type(s) present in a biological sample and for diagnosis of diseases and conditions: immune disorders, particularly defects in T cell activation; hematopoietic disorders, particularly tumors of hematopoietic and/or adrenal gland origin. Similarly, polypeptides and antibodies directed to these polypeptides are useful in providing immunological probes for differential identification of the tissue(s) or cell type(s). For a number of disorders of the above tissues or cells, particularly of the hematopoietic and/or endocrine systems, expression of this gene at significantly higher or lower levels may be routinely detected in certain tissues and cell types (e.g., cells and tissues of the immune system, hematopoietic cells, blood cells, liver, and adrenal gland, and cancerous and wounded tissues) or bodily fluids (e.g. lymph, amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for immune and/or hematopoietic disorders; diseases related to proliferation and/or differentiation of hematopoietic cells; defects in T cell and neutrophil activation and responsiveness; and endocrine and/or metabolic disorders, particularly of early childhood and development. Protein, as well as, antibodies directed against the protein may show utility as a tumor marker and/or immunotherapy targets for the above listed tissues.

Preferred epitopes include those comprising a sequence shown in SEQ ID NO.444 as residues: Met-1 to His-6.

Many polynucleotide sequences, such as EST sequences, are publicly available and accessible through sequence databases. Some of these sequences are related to SEQ ID NO:135 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1993 of SEQ ID NO:135, b is an integer of 15 to 2007, where both a and b correspond to the positions of nucleotide residues shown in SEQ ID NO:135, and where the b is greater than or equal to a+14.

Features of Protein Encoded by Gene No: 126

The gene encoding the disclosed cDNA is believed to reside on chromosome 1. Accordingly, polynucleotides related to this invention are useful as a marker in linkage analysis for chromosome 1.

This gene is expressed primarily in placenta and endothelial cells and to a lesser extent in melanocytes and embryonic tissues.

Therefore, polynucleotides and polypeptides of the invention are useful as reagents for differential identification of the tissue(s) or cell type(s) present in a biological sample and for diagnosis of diseases and conditions: tumors of an endothelial cell origin; angiogenesis associated with tumor development and metastasis. Similarly, polypeptides and antibodies directed to these polypeptides are useful in providing immunological probes for differential identification of the tissue(s) or cell type(s). For a number of disorders of the above tissues or cells, particularly of the vascular system and developing embryo, expression of this gene at significantly higher or lower levels may be routinely detected in certain tissues and cell types (e.g., placenta, endothelial cells, melanocytes, and embryonic tissues, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for treatment of developmental disorders; inhibition of angiogenesis; and vascular patterning. Protein, as well as, antibodies directed against the protein may show utility as a tumor marker and/or immunotherapy targets for the above listed tissues.

Preferred epitopes include those comprising a sequence shown in SEQ ID NO.445 as residues: Pro-16 to Gln-21.

Many polynucleotide sequences, such as EST sequences, are publicly available and accessible through sequence databases. Some of these sequences are related to SEQ ID NO:136 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1277 of SEQ ID NO:136, b is an integer of 15 to 1291, where both a and b correspond to the positions of nucleotide residues shown in SEQ ID NO:136, and where the b is greater than or equal to a+14.

Features of Protein Encoded by Gene No: 127

This gene is expressed primarily in endothelial cells and hematopoietic tissues, including spleen, tonsils, leukocytes, and both B- and T-cell lymphomas.

Therefore, polynucleotides and polypeptides of the invention are useful as reagents for differential identification of the tissue(s) or cell type(s) present in a biological sample and for diagnosis of diseases and conditions: immune disorders, particularly tumors of an endothelial cell and/or hematopoietic origin; leukemias and lymphomas. Similarly, polypeptides and antibodies directed to these polypeptides are useful in providing immunological probes for differential identification of the tissue(s) or cell type(s). For a number of disorders of the above tissues or cells, particularly of the immune and vascular systems, expression of this gene at significantly higher or lower levels may be routinely detected in certain tissues and cell types (e.g., endothelial cells, hematopoietic cells, spleen, tonsils, and blood cells, and cancerous and wounded tissues) or bodily fluids (e.g. lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for the manipulation of angiogenesis; the differentiation and morphogenesis of endothelial cells; the proliferation and/or differentiation of hematopoietic cells; and the commitment of hematopoietic cells to distinct cell lineages. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:137 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1892 of SEQ ID NO:137, b is an integer of 15 to 1906, where both a and b correspond to the positions of nucleotide residues shown in SEQ ID NO:137, and where the b is greater than or equal to a+14.

Features of Protein Encoded by Gene No: 128

The gene encoding the disclosed cDNA is thought to reside on chromosome 11. Accordingly, polynucleotides related to this invention are useful as a marker in linkage analysis for chromosome 11.

It has been discovered that this gene is expressed primarily in kidney medulla and to a lesser extent in spleen from chronic myelogenous leukemia patients, prostate cancer, and some other tissues.

Therefore, nucleic acids of the invention are useful as reagents for differential identification of the tissue(s) or cell type(s) present in a biological sample and for diagnosis of the following diseases and conditions: tumors of a kidney origin; chromic myelogenous leukemia; prostate cancer. Similarly, polypeptides and antibodies directed to those polypeptides are useful to provide immunological probes for differential identification of the tissue(s) or cell type(s). For a number of disorders of the above tissues or cells, particularly of the kidney and spleen, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution suggests that the protein product of this clone would be useful for the diagnosis and treatment of kidney disorders and cancer, particularly chronic myelogenous leukemia and prostate cancer. It may also be useful for the enhancement of kidney tubule regeneration in the treatment of acute renal failure. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:138 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1921 of SEQ ID NO:138, b is an integer of 15 to 1935, where both a and b correspond to the positions of nucleotide residues shown in SEQ ID NO:138, and where the b is greater than or equal to a+14.

Features of Protein Encoded by Gene No: 129

The sequence shares homology with a rat neuroligin protein, which is thought to play a role in recognition between neurons. All neuroligins contain an N-terminal hydrophobic sequence with the characteristics of a cleaved signal peptide followed by a large esterase homology domain, a highly conserved single transmembrane region, and a short cytoplasmic domain. Neuroligins constitute a multigene family of brain-specific proteins with distinct isoforms that may have overlapping functions in mediating recognition processes between neurons. The gene encoding the disclosed cDNA is thought to reside on chromosome 17. Accordingly, polynucleotides related to this invention are useful as a marker in linkage analysis for chromosome 17.

It has been discovered that this gene is expressed primarily in adult and infant brain and to a lesser extent in mesenchymal or fibroblast cells, as well as tissues with a mesenchymal origin.

Therefore, nucleic acids of the invention are useful as reagents for differential identification of the tissue(s) or cell type(s) present in a biological sample and for diagnosis of the following diseases and conditions: tumors of a brain and/or mesenchymal origin; neurodegenerative disorders; cancer; fibrosis. Similarly, polypeptides and antibodies directed to those polypeptides are useful to provide immunological probes for differential identification of the tissue(s) or cell type(s). For a number of disorders of the above tissues or cells, particularly of the brain and of mesenchymal cells and tissues, expression of this gene at significantly higher or lower levels may be detected in certain tissues or cell types (e.g., cancerous and wounded tissues) or bodily fluids (e.g., serum, plasma, urine, synovial fluid or spinal fluid) taken from an individual having such a disorder, relative to the standard gene expression level, i.e., the expression level in healthy tissue from an individual not having the disorder.

The tissue distribution and homology to neuroligins suggests that the protein product of this clone would be useful for the diagnosis of tumors of a brain and/or mesenchymal origin; neurodegenerative disorders; cancer; and fibrosis, based upon the expression of this gene within those tissues. Fibrosis is considered as mesenchymal cells and fibroblasts are the primary cellular targets involved in this pathological condition.

Preferred epitopes include those comprising a sequence shown in SEQ ID NO.448 as residues: Ser-42 to Pro-47.

Many polynucleotide sequences, such as EST sequences, are publicly available and accessible through sequence databases. Some of these sequences are related to SEQ ID NO:139 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1432 of SEQ ID NO:139, b is an integer of 15 to 1446, where both a and b correspond to the positions of nucleotide residues shown in SEQ ID NO:139, and where the b is greater than or equal to a+14.

Features of Protein Encoded by Gene No: 130

This gene is expressed primarily in hepatocellular cancer and to a lesser extent in fetal tissues as well as testes tumor.

Therefore, polynucleotides and polypeptides of the invention are useful as reagents for differential identification of the tissue(s) or cell type(s) present in a biological sample and for diagnosis of diseases and conditions: hepatic, developmental, or reproductive disorders, particularly liver cancer. Similarly, polypeptides and antibodies directed to these polypeptides are useful in providing immunological probes for differential identification of the tissue(s) or cell type(s). For a number of disorders of the above tissues or cells, particularly of the digestive system, expression of this gene at significantly higher or lower levels may be routinely detected in certain tissues and cell types (e.g., liver, fetal tissue, and testes and other reproductive tissue, and cancerous and wounded tissues) or bodily fluids (e.g. lymph, amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution suggests that the protein product of this clone would be useful for the detection and treatment of liver disorders and cancers (e.g. hepatoblastoma, jaundice, hepatitis, liver metabolic diseases and conditions that are attributable to the differentiation of hepatocyte progenitor cells). Similarly, expression within fetal tissues and other cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:140 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1095 of SEQ ID NO:140, b is an integer of 15 to 1109, where both a and b correspond to the positions of nucleotide residues shown in SEQ ID NO:140, and where the b is greater than or equal to a+14.

Features of Protein Encoded by Gene No: 131

This gene is expressed only in infant early brain.

Therefore, polynucleotides and polypeptides of the invention are useful as reagents for differential identification of the tissue(s) or cell type(s) present in a biological sample and for diagnosis of diseases and conditions: development and neural disorders, particularly neurodegenerative disorders. Similarly, polypeptides and antibodies directed to these polypeptides are useful in providing immunological probes for differential identification of the tissue(s) or cell type(s). For a number of disorders of the above tissues or cells, particularly of the brain and nervous system, expression of this gene at significantly higher or lower levels may be routinely detected in certain tissues and cell types (e.g., brain and other tissue of the nervous system and cancerous and wounded tissues) or bodily fluids (e.g. amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for treating diseases of the brain in children and in treating nervous system disorders such as Alzheimer's disease, schizophrenia, dementia, depression, etc. Similarly, expression within fetal tissues and other cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:141 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 483 of SEQ ID NO:141, b is an integer of 15 to 497, where both a and b correspond to the positions of nucleotide residues shown in SEQ ID NO:141, and where the b is greater than or equal to a+14.

Features of Protein Encoded by Gene No: 132

The gene encoding the disclosed cDNA is believed to reside on chromosome 14. Accordingly, polynucleotides related to this invention are useful as a marker in linkage analysis for chromosome 14.

This gene is expressed primarily in brain and to a lesser extent in glioblastoma.

Therefore, polynucleotides and polypeptides of the invention are useful as reagents for differential identification of the tissue(s) or cell type(s) present in a biological sample and for diagnosis of diseases and conditions: neural disorders, particularly Alzheimer's disease, schizophrenia, depression, mania, and dementia. Similarly, polypeptides and antibodies directed to these polypeptides are useful in providing immunological probes for differential identification of the tissue(s) or cell type(s). For a number of disorders of the above tissues or cells, particularly of the brain and nervous system, expression of this gene at significantly higher or lower levels may be routinely detected in certain tissues and cell types (e.g., brain and other tissue of the nervous system, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for treating brain disorders such as Alzheimer's disease, schizophrenia, depression, mania, and dementia. Protein, as well as, antibodies directed against the protein may show utility as a tumor marker and/or immunotherapy targets for the above listed tissues.

Preferred epitopes include those comprising a sequence shown in SEQ ID NO.451 as residues: Met-1 to Cys-8, Pro-10 to Gly-16, Gln-76 to Lys-89.

Many polynucleotide sequences, such as EST sequences, are publicly available and accessible through sequence databases. Some of these sequences are related to SEQ ID NO:142 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 255 of SEQ ID NO:142, b is an integer of 15 to 269, where both a and b correspond to the positions of nucleotide residues shown in SEQ ID NO:142, and where the b is greater than or equal to a+14.

Features of Protein Encoded by Gene No: 133

The translation product of this gene shares sequence homology with ribitol dehydrogenase of Caenorhabditis elegans which is thought to be important in metabolism of sugars, in addition to being a key enzyme in biosynthesis pathways (See Genbank Accession No. gi|1125838).

This gene is expressed primarily in macrophage and to a lesser extent in T-cell lymphoma and lung.

Therefore, polynucleotides and polypeptides of the invention are useful as reagents for differential identification of the tissue(s) or cell type(s) present in a biological sample and for diagnosis of diseases and conditions: immune disorders, particularly tissue destruction in inflammation. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues and cell types (e.g. immune, blood cells and lung, and cancerous and wounded tissues) or bodily fluids (e.g. lymph, pulmonary surfactant, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to ribitol dehydrogenase indicate that polynucleotides and polypeptides corresponding to this gene are useful for altering macrophage metabolism in diseases such as inflammation where macrophages are known to cause excess tissue destruction. Protein, as well as, antibodies directed against the protein may show utility as a tumor marker and/or immunotherapy targets for the above listed tissues.

Preferred epitopes include those comprising a sequence shown in SEQ ID NO.452 as residues: Thr-87 to Lys-93, Thr-247 to Ser-253, Pro-299 to Ser-311, Ser-315 to Arg-320.

Many polynucleotide sequences, such as EST sequences, are publicly available and accessible through sequence databases. Some of these sequences are related to SEQ ID NO:143 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1255 of SEQ ID NO:143, b is an integer of 15 to 1269, where both a and b correspond to the positions of nucleotide residues shown in SEQ ID NO:143, and where the b is greater than or equal to a+14.

Features of Protein Encoded by Gene No: 134

The gene encoding the disclosed cDNA is believed to reside on chromosome 3. Accordingly, polynucleotides related to this invention are useful as a marker in linkage analysis for chromosome 3.

This gene is expressed primarily in pancreatic tumors, and to a lesser extent in synovial sarcoma.

Therefore, polynucleotides and polypeptides of the invention are useful as reagents for differential identification of the tissue(s) or cell type(s) present in a biological sample and for diagnosis of diseases and conditions which include, but are not limited to, endocrine, gastrointestinal, or skeletal disorders,particularly those involving proliferating tissues, such as tumors or cancers. Similarly, polypeptides and antibodies directed to these polypeptides are useful in providing immunological probes for differential identification of the tissue(s) or cell type(s). For a number of disorders of the above tissues or cells, particularly of the endocrine and connective tissue systems, expression of this gene at significantly higher or lower levels may be routinely detected in certain tissues and cell types (e.g., pancreas, and synovial tissue, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for treating and diagnosing various cancers. Similarly, expression within pancreatic tumors and other cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:144 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1930 of SEQ ID NO:144, b is an integer of 15 to 1944, where both a and b correspond to the positions of nucleotide residues shown in SEQ ID NO:144, and where the b is greater than or equal to a+14.

Features of Protein Encoded by Gene No: 135

This gene is expressed primarily in T cell lines such as Raji and to a lesser extent in infant brain.

Therefore, polynucleotides and polypeptides of the invention are useful as reagents for differential identification of the tissue(s) or cell type(s) present in a biological sample and for diagnosis of diseases and conditions: immune, developmental, or neural disorders, particularly inflammation. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues and cell types (e.g., blood cells, and brain and other tissue of the nervous system, and cancerous and wounded tissues) or bodily fluids (e.g. lymph, amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for treating and diagnosing inflammatory diseases such as rheumatoid arthritis, sepsis, inflammatory bowel disease, and psoriasis, as well as neutropenia. Protein, as well as, antibodies directed against the protein may show utility as a tumor marker and/or immunotherapy targets for the above listed tissues.

Preferred epitopes include those comprising a sequence shown in SEQ ID NO.454 as residues: Pro-16 to Arg-34, Gly-45 to Asn-50.

Many polynucleotide sequences, such as EST sequences, are publicly available and accessible through sequence databases. Some of these sequences are related to SEQ ID NO:145 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1007 of SEQ ID NO:145, b is an integer of 15 to 1021, where both a and b correspond to the positions of nucleotide residues shown in SEQ ID NO:145, and where the b is greater than or equal to a+14.

Features of Protein Encoded by Gene No: 136

The translation product of this gene shares high sequence homology with SAR1 subfamily of GTP-binding proteins which is thought to be important in vesicular transport in mammalian cells. In specific embodiments, polypeptides of the invention comprise the following amino acid sequence: ARGGPRQPSRFAVRSPGVRPTPSRGLRSLQSQTL SDLD (SEQ ID NO:709), GFSSVLQFLGLYKK (SEQ ID NO:710), GKLVFLGLD NAGKTTLLHMLKDDRLGQH- VPTLHPT (SEQ ID NO:711), SEELTIAGMTFTTF DLGGH (SEQ ID NO:712), QARRVWKNYLPAINGIV- FLVDCADH (SEQ ID NO:713), NVPILILGNKIDR (SEQ ID NO:714), or EVFMCSVLKRQGYGEGFRW (SEQ ID NO:715). Polynucleotides encoding these polypeptides are also encompassed by the invention.

This gene is expressed primarily in serum-stimulated smooth muscle cells and to a lesser extent in a T-cell lymphoma.

Therefore, polynucleotides and polypeptides of the invention are useful as reagents for differential identification of the tissue(s) or cell type(s) present in a biological sample and for diagnosis of diseases and conditions: vascular, muscular, immune, or metabolic disorders or diseases, particularly those affecting vesicular transport. Similarly, polypeptides and antibodies directed to these polypeptides are useful in providing immunological probes for differential identification of the tissue(s) or cell type(s). For a number of disorders of the above tissues or cells, particularly of the muscular system, expression of this gene at significantly higher or lower levels may be routinely detected in certain tissues and cell types (e.g., blood cells, and smooth muscle, and cancerous and wounded tissues) or bodily fluids (e.g. lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to GTP-binding proteins indicate that polynucleotides and polypeptides corresponding to this gene are useful for gene therapy in treating the large number of diseases involved in defective vesicular transport within cells. Protein, as well as, antibodies directed against the protein may show utility as a tumor marker and/or immunotherapy targets for the above listed tissues.

Preferred epitopes include those comprising a sequence shown in SEQ ID NO.455 as residues: Lys-46 to Gln-52, Leu-108 to Leu-115, Gly-155 to Lys-160, Lys-182 to Phe-190.

Many polynucleotide sequences, such as EST sequences, are publicly available and accessible through sequence databases. Some of these sequences are related to SEQ ID NO:146 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1271 of SEQ ID NO:146, b is an integer of 15 to 1285, where both a and b correspond to the positions of nucleotide residues shown in SEQ ID NO:146, and where the b is greater than or equal to a+14.

Features of Protein Encoded by Gene No: 137

The translation product of this gene shares sequence homology with a protein found in *C. elegans* cosmid F25B5. The gene encoding the disclosed cDNA is believed to reside on chromosome 17. Accordingly, polynucleotides related to this invention are useful as a marker in linkage analysis for chromosome 17.

This gene is expressed primarily in a fetal tissues and to a lesser extent in melanocytes.

Therefore, polynucleotides and polypeptides of the invention are useful as reagents for differential identification of the tissue(s) or cell type(s) present in a biological sample and for diagnosis of diseases and conditions: abnormal fetal development, especially of the pulmonary or integumentary system. Similarly, polypeptides and antibodies directed to these polypeptides are useful in providing immunological probes for differential identification of the tissue(s) or cell type(s). For a number of disorders of the above tissues or cells, particularly of the fetal pulmonary system, expression of this gene at significantly higher or lower levels may be routinely detected in certain tissues and cell types (e.g., fetal tissue, pulmonary tissue, and melanocytes, and cancerous and wounded tissues) or bodily fluids (e.g. lymph, amniotic fluid, pulmonary surfactant, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for treatment and diagnosis of diseases affecting the pulmonary system, such as emphysema. Similarly, expression within fetal tissue and other cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Preferred epitopes include those comprising a sequence shown in SEQ ID NO.456 as residues: Ala-7 to Ser-15, Asp-47 to Lys-55, Tyr-160 to Val-166.

Many polynucleotide sequences, such as EST sequences, are publicly available and accessible through sequence databases. Some of these sequences are related to SEQ ID NO:147 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1372 of SEQ ID NO:147, b is an integer of 15 to 1386, where both a and b correspond to the positions of nucleotide residues shown in SEQ ID NO:147, and where the b is greater than or equal to a+14.

Features of Protein Encoded by Gene No: 138

The gene encoding the disclosed cDNA is believed to reside on chromosome 11. Accordingly, polynucleotides related to this invention are useful as a marker in linkage analysis for chromosome 11.

This gene is expressed primarily in gall bladder and to a lesser extent in smooth muscle.

Therefore, polynucleotides and polypeptides of the invention are useful as reagents for differential identification of the tissue(s) or cell type(s) present in a biological sample and for diagnosis of diseases and conditions: gastrointestinal, digestive system, or vascular disorders, particularly atherosclerosis, vasculitis, aneurysm, and gall bladder problems. Similarly, polypeptides and antibodies directed to these polypeptides are useful in providing immunological probes for differential identification of the tissue(s) or cell type(s). For a number of disorders of the above tissues or cells, particularly of the digestive system, expression of this gene at significantly higher or lower levels may be routinely detected in certain tissues and cell types (e.g., gall bladder and tissue of the digestive system, and smooth muscle, and cancerous and wounded tissues) or bodily fluids (e.g. bile, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for treating diseases of the digestive or cardiopulmonary system. Protein, as well as, antibodies directed against the protein may show utility as a tumor marker and/or immunotherapy targets for the above listed tissues.

Preferred epitopes include those comprising a sequence shown in SEQ ID NO.457 as residues: Leu-50 to Ala-59, Pro-75 to Thr-80.

Many polynucleotide sequences, such as EST sequences, are publicly available and accessible through sequence databases. Some of these sequences are related to SEQ ID NO:148 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2084 of SEQ ID NO:148, b is an integer of 15 to 2098, where both a and b correspond to the positions of nucleotide residues shown in SEQ ID NO:148, and where the b is greater than or equal to a+14.

Features of Protein Encoded by Gene No: 139

Polypeptides of the invention do not comprise the amino acid sequence shown as Genbank accession no. W42028, which is hereby incorporated herein by reference. It is likely that the open reading frame containing the predicted signal peptide continues in the 5' direction. In specific embodiments, polypeptides of the invention comprise the following amino acid sequence: STHASELR-RRREPVGVWSSRRPRGPDAAPGA GRRWCXAASGP-PRAATSEPSATAGVRRAAGPAGPGARX-ARRGGVELIRI (SEQ ID NO: 716). Polynucleotides encoding these polypeptides are also encompassed by the invention. The gene encoding the disclosed cDNA is believed to reside on chromosome 7. Accordingly, polynucleotides related to this invention are useful as a marker in linkage analysis for chromosome 7.

This gene is expressed primarily in placenta and to a lesser extent in brain.

Therefore, polynucleotides and polypeptides of the invention are useful as reagents for differential identification of the tissue(s) or cell type(s) present in a biological sample and for diagnosis of diseases and conditions: developmental, reproductive, or neural disorders, particularly abnormal fetal development. Similarly, polypeptides and antibodies directed to these polypeptides are useful in providing immunological probes for differential identification of the tissue(s) or cell type(s). For a number of disorders of the above tissues or cells, particularly of developing tissues, expression of this gene at significantly higher or lower levels may be routinely detected in certain tissues and cell types (e.g., placenta, and brain and other tissue of the nervous system, and cancerous and wounded tissues) or bodily fluids (e.g. lymph, amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for treating and diagnosing abnormal fetal development, reproductive, or neural disorders. Protein, as well as, antibodies directed against the protein may show utility as a tumor marker and/or immunotherapy targets for the above listed tissues.

Preferred epitopes include those comprising a sequence shown in SEQ ID NO.458 as residues: Leu-78 to Thr-88, Gly-92 to Gly-108.

Many polynucleotide sequences, such as EST sequences, are publicly available and accessible through sequence databases. Some of these sequences are related to SEQ ID NO:149 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1833 of SEQ ID NO:149, b is an integer of 15 to 1847, where both a and b correspond to the positions of nucleotide residues shown in SEQ ID NO:149, and where the b is greater than or equal to a+14.

Features of Protein Encoded by Gene No: 140

In specific embodiments, polypeptides of the invention comprise the following amino acid sequence: ECLDCHL-HCCLLDQVVPKHYTLDASLPLRLRPES MEKLRCL-RACVIRSLYHMYEPFAARISKNPAIP-ESTPSTLKNSKCLLFWCRKIVG NRQEPMWEFNFKFKKQSPRLKSKCTG-GLQPPVQYEDVHTNPDQDCCLLQVTTL NFIFIPIV-MGMIFTLFTINVSTDMRHHRVRLVFQD-SPVHGGRKLRSEQGVQVILDP VHSVRLFDWWHPQYPFSLRA (SEQ ID NO:717). Polynucleotides encoding these polypeptides are also encompassed by the invention.

This gene is expressed primarily in smooth muscle and to a lesser extent in ovary, prostate cancer, and activated monocytes.

Therefore, polynucleotides and polypeptides of the invention are useful as reagents for differential identification of the tissue(s) or cell type(s) present in a biological sample and for diagnosis of diseases and conditions: vascular disorders, particularly hypertension and atherosclerosis. Similarly, polypeptides and antibodies directed to these polypeptides are useful in providing immunological probes for differential identification of the tissue(s) or cell type(s). For a number of disorders of the above tissues or cells, particularly of the circulatory system, expression of this gene at significantly higher or lower levels may be routinely detected in certain tissues and cell types (e.g., smooth muscle, ovary and other reproductive tissue, prostate, and blood cells, and cancerous and wounded tissues) or bodily fluids (e.g. lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for treating diseases of the circulatory system, such as hypertension, atherosclerosis, etc. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:150 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1555 of SEQ ID NO:150, b is an integer of 15 to 1569, where both a and b correspond to the positions of nucleotide residues shown in SEQ ID NO:150, and where the b is greater than or equal to a+14.

Features of Protein Encoded by Gene No: 141

Polynucleotides of the invention do not comprise the nucleic acid sequence shown as Genbank accession no. gb|G11389|G11389 which is hereby incorporated herein by reference.

This gene is expressed primarily in fetal spleen, and to a lesser extent in placenta and bone marrow.

Therefore, polynucleotides and polypeptides of the invention are useful as reagents for differential identification of the tissue(s) or cell type(s) present in a biological sample and for diagnosis of diseases and conditions: developmental, immune, hematopoietic, or reproductive disorders, particularly anemia and other diseases affecting blood cells. Similarly, polypeptides and antibodies directed to these polypeptides are useful in providing immunological probes for differential identification of the tissue(s) or cell type(s). For a number of disorders of the above tissues or cells, particularly of the circulatory and pulmonary systems, expression of this gene at significantly higher or lower levels may be routinely detected in certain tissues and cell types (e.g., spleen, placenta, reproductive, developmental, hematopoietic, bone marrow, and blood cells, and cancerous and wounded tissues) or bodily fluids (e.g. amniotic fluid, lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in fetal spleen and bone marrow suggests that the protein product of this clone would be useful for the treatment and diagnosis of hematopoetic related disorders such as anemia, pancytopenia, leukopenia, thrombocytopenia or leukemia since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Alternatively, expression within fetal tissues and other cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Preferred epitopes include those comprising a sequence shown in SEQ ID NO.460 as residues: Leu-50 to Lys-58, Lys-64 to Leu-71, His-89 to Thr-94, Pro-102 to Trp-110, Tyr-162 to Cys-169, Asp-367 to Ala-377.

Many polynucleotide sequences, such as EST sequences, are publicly available and accessible through sequence databases. Some of these sequences are related to SEQ ID NO:151 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1526 of SEQ ID NO:151, b is an integer of 15 to 1540, where both a and b correspond to the positions of nucleotide residues shown in SEQ ID NO:151, and where the b is greater than or equal to a+14.

Features of Protein Encoded by Gene No: 142

The predicted translation product of this contig is a human homolog of the murine tetracycline/sugar transporter molecule recently reported by Matsuo and colleagues (Biochem. Biophys. Res. Commun. 238 (1), 126–129 (1997), incorporated herein by reference). In specific embodiments, polypeptides of the invention comprise the following amino acid sequence: LMRSIGNKNT (SEQ ID NO:718), AWYG-FGSEPC (SEQ ID NO:719), SSITFPAVSALVSRTAD (SEQ ID NO:720), ADQQGVVQGMITGIRGLCNGLGP ALYGFIFYIFHVELKELPITGTDLGTNTSPQHHFEQN (SEQ ID NO:721), SIIPGPPFLFGACS (SEQ ID NO:722), FIPEHTNLSLRSSSWRKHCGSHSHPH NTQAPGEAKEP (SEQ ID NO:723), or LLQDTNV (SEQ ID NO:724). Polynucleotides encoding these polypeptides are also encompassed by the invention.

This gene is expressed primarily in synovium and to a lesser extent in endothelial cells.

Therefore, polynucleotides and polypeptides of the invention are useful as reagents for differential identification of the tissue(s) or cell type(s) present in a biological sample and for diagnosis of diseases and conditions: skeletal disorders, particularly rheumatoid arthritis and inflammation. Similarly, polypeptides and antibodies directed to these polypeptides are useful in providing immunological probes for differential identification of the tissue(s) or cell type(s). For a number of disorders of the above tissues or cells, particularly of the immune and lymphatic systems, expression of this gene at significantly higher or lower levels may be routinely detected in certain tissues and cell types (e.g., synovial tissue, and endothelial cells, and cancerous and wounded tissues) or bodily fluids (e.g. lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for treatment and diagnosis of inflammatory diseases, such as rheumatoid arthritis, leukemia, neutropenia, inflammatory bowel disease, psoriasis, sepsis, and the like. In addition, the protein product of this clone may also be useful for the treatment and diagnosis of a variety of autoimmune disorders, as rheumatoid arthritis, lupus, scleroderma, and dermatomyositis as well as dwarfism, spinal deformation, and specific joint abnormalities as well as chondrodysplasias (ie. spondyloepiphyseal dysplasia congenita, familial osteoarthritis, Atelosteogenesis type II, metaphyseal chondrodysplasia type Schmid). Protein, as well as, antibodies directed against the protein may show utility as a tumor marker and/or immunotherapy targets for the above listed tissues.

Preferred epitopes include those comprising a sequence shown in SEQ ID NO.461 as residues: Leu-106 to Gln-113, Arg-153 to Lys-177.

Many polynucleotide sequences, such as EST sequences, are publicly available and accessible through sequence databases. Some of these sequences are related to SEQ ID NO:152 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1705 of SEQ ID NO:152, b is an integer of 15 to 1719, where both a and b correspond to the positions of nucleotide residues shown in SEQ ID NO:152, and where the b is greater than or equal to a+14.

Features of Protein Encoded by Gene No: 143

It is likely that the open reading frame containing the predicted signal peptide continues in the 5' direction. In specific embodiments, polypeptides of the invention comprise the following amino acid sequence: SKGNSSHSKELEASPSVVGRQPGA VFWELWDVPLGARENRRK (SEQ ID NO:725). Polynucleotides encoding these polypeptides are also encompassed by the invention.

This gene is expressed primarily in placenta and to a lesser extent in melanocyte, fetal liver and spleen, and bone marrow.

Therefore, polynucleotides and polypeptides of the invention are useful as reagents for differential identification of the tissue(s) or cell type(s) present in a biological sample and for diagnosis of diseases and conditions: abnormal early development. Similarly, polypeptides and antibodies directed to these polypeptides are useful in providing immunological probes for differential identification of the tissue(s) or cell type(s). For a number of disorders of the above tissues or cells, lower levels may be routinely detected in certain tissues and cell types (e.g., placenta, hematopoietic, integumentary, developmental, liver, spleen, and bone marrow, and cancerous and wounded tissues) or bodily fluids (e.g. amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for the treatment and diagnosis of abnormal early development phenomena and diseases. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:153 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 849 of SEQ ID NO:153, b is an integer of 15 to 863, where both a and b correspond to the positions of nucleotide residues shown in SEQ ID NO:153, and where the b is greater than or equal to a+14.

Features of Protein Encoded by Gene No: 144

Polynucleotides of the invention do not comprise the nucleic acid sequence shown as Genbank accession no. gb|G15249|G15249, which is hereby incorporated herein by reference.

This gene is expressed primarily in fetal liver and spleen.

Therefore, polynucleotides and polypeptides of the invention are useful as reagents for differential identification of the tissue(s) or cell type(s) present in a biological sample and for diagnosis of diseases and conditions: developmental or immune disorders, particularly anemia and neutropenia. Similarly, polypeptides and antibodies directed to these polypeptides are useful in providing immunological probes for differential identification of the tissue(s) or cell type(s). For a number of disorders of the above tissues or cells, particularly of the immune and blood systems, expression of this gene at significantly higher or lower levels may be routinely detected in certain tissues and cell types (e.g., liver and spleen, developmental, immune, hematopoietic, and cancerous and wounded tissues) or bodily fluids (e.g. amniotic fluid, lymph, bile, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful in hematopoeisis and bone marrow regeneration as it is most abundant in fetal tissues responsible for the generation of hematopoeitic cells. Similarly, expression within fetal tissues and other cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Preferred epitopes include those comprising a sequence shown in SEQ ID NO.463 as residues: Ser-35 to Lys-46.

Many polynucleotide sequences, such as EST sequences, are publicly available and accessible through sequence databases. Some of these sequences are related to SEQ ID NO:154 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1087 of SEQ ID NO:154, b is an integer of 15 to 1101, where both a and b correspond to the positions of nucleotide residues shown in SEQ ID NO:154, and where the b is greater than or equal to a+14.

Features of Protein Encoded by Gene No: 145

The gene encoding the disclosed cDNA is believed to reside on chromosome 3. Accordingly, polynucleotides related to this invention are useful as a marker in linkage analysis for chromosome 3.

The translation product of this gene shares sequence homology with protein tyrosine phosphatase which is thought to be important in transducing signals to activate cells such as T cell, B cell and other cell types.

This gene is expressed primarily in T cells and tissues in early stages of development and to a lesser extent in cancers.

Therefore, polynucleotides and polypeptides of the invention are useful as reagents for differential identification of the tissue(s) or cell type(s) present in a biological sample and for diagnosis of diseases and conditions: immuno-related diseases and cancer. Similarly, polypeptides and antibodies directed to these polypeptides are useful in providing immunological probes for differential identification of the tissue(s) or cell type(s). For a number of disorders of the above tissues or cells, particularly of the immune system expression of this gene at significantly higher or lower levels may be routinely detected in certain tissues and cell types (e.g., embryonic and fetal tissue, undifferentiated cells, and blood cells, immune tissues, and cancerous and wounded tissues) or bodily fluids (e.g. lymph, amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to the protein tyrosine phosphatase suggests that the protein product of this clone would be useful for the diagnosis and treatment of a variety of immune system disorders. Expression of this gene product in T-cells suggests a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:155 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2017 of SEQ ID NO:155, b is an integer of 15 to 2031, where both a and b correspond to the positions of nucleotide residues shown in SEQ ID NO:155, and where the b is greater than or equal to a+14.

Features of Protein Encoded by Gene No: 146

This gene is expressed primarily in T cell and to a lesser extent in B cell, macrophages and tumor tissues.

Therefore, polynucleotides and polypeptides of the invention are useful as reagents for differential identification of the tissue(s) or cell type(s) present in a biological sample and for diagnosis of diseases and conditions: immuno-disorders. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues and cell types (e.g. immune, blood cells, and cancerous and wounded tissues) or bodily fluids (e.g. lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for regulating the immune system and therefore can be used in treating diseases such as autoimmune diseases and cancers. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:156 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1967 of SEQ ID NO:156, b is an integer of 15 to 1981, where both a and b correspond to the positions of nucleotide residues shown in SEQ ID NO:156, and where the b is greater than or equal to a+14.

Features of Protein Encoded by Gene No: 147

This gene is expressed primarily in placenta, and to a lesser extent in endothelial cells, testis tumor, ovarian cancer, uterine cancer.

Therefore, polynucleotides and polypeptides of the invention are useful as reagents for differential identification of the tissue(s) or cell type(s) present in a biological sample and for diagnosis of diseases and conditions which include, but are not limited to cancer. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues and cell types (e.g., placenta, endothelial cells, testis and ovary and other reproductive tissue, and cancerous and wounded tissues) or bodily fluids (e.g. lympp, amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for diagnosis and treatment of cancers or reproductive disorders. Protein, as well as, antibodies directed against the protein may show utility as a tumor marker and/or immunotherapy targets for the above listed tissues.

Preferred epitopes include those comprising a sequence shown in SEQ ID NO.466 as residues: Lys-136 to Thr-145.

Many polynucleotide sequences, such as EST sequences, are publicly available and accessible through sequence databases. Some of these sequences are related to SEQ ID NO:157 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 901 of SEQ ID NO:157, b is an integer of 15 to 915, where both a and b correspond to the positions of nucleotide residues shown in SEQ ID NO:157, and where the b is greater than or equal to a+14.

Features of Protein Encoded by Gene No: 148

This sequence has significant homology to mouse torsin A. Recently, another group cloned the human Torsin A gene. (See, Accession No. 2358279; see also Nature Genet. 17, 40–48 (1997), incorporated herein by reference.) In specific embodiments, polypeptides of the invention comprise the following amino acid sequence: VEPISLGLALAGVLT-GYIYP (SEQ ID NO: 726), PLTLSLHGWTGTGKN-FVSKIIAENIYE (SEQ ID NO:727), NITLYKDQLQLW IRGNVSACARSI (SEQ ID NO:728), DFWRS-GKQREDIKLKDIEHALSVSVFN (SEQ ID NO: 729), LIDYFVPFLPLEYKHLKMCIRV (SEQ ID NO:730), VSR-VAEEMTF FPKEERVF (SEQ ID NO:731). Polynucleotides encoding these polypeptides are also encompassed by the invention.

This gene is expressed primarily in osteoclastoma, T-cell, and placenta and to a lesser extent in fetal lung, fetal liver, fetal brain, adult brain and tumor tissues Therefore, polynucleotides and polypeptides of the invention are useful as reagents for differential identification of the tissue(s) or cell type(s) present in a biological sample and for diagnosis of diseases and conditions: disease conditions in hematopoiesis and cancers. Similarly, polypeptides and antibodies directed to these polypeptides are useful in providing immunological probes for differential identification of the tissue(s) or cell type(s). For a number of disorders of the above tissues or cells, particularly of the hematopoiesis system, expression of this gene at significantly higher or lower levels may be routinely detected in certain tissues and cell types (e.g., blood cells, bone, placenta, lung, liver, and brain and other tissues of the nervous system, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for treating blood related diseases such as deficiencies in red blood cell, white blood cell, platelet and other hematopoiesis cells. Protein, as well as, antibodies directed against the protein may show utility as a tumor marker and/or immunotherapy targets for the above listed tissues.

Preferred epitopes include those comprising a sequence shown in SEQ ID NO.467 as residues: Cys-50 to Ser-57, Asn-88 to Pro-95, Trp-222 to Lys-232, Asn-246 to Phe-252, Gln-286 to Ile-292, Asp-327 to Asp-332.

Many polynucleotide sequences, such as EST sequences, are publicly available and accessible through sequence databases. Some of these sequences are related to SEQ ID NO:158 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2103 of SEQ ID NO:158, b is an integer of 15 to 2117, where both a and b correspond to the positions of nucleotide residues shown in SEQ ID NO:158, and where the b is greater than or equal to a+14.

Features of Protein Encoded by Gene No: 149

The gene encoding the disclosed cDNA is believed to reside on chromosome 6. Accordingly, polynucleotides related to this invention are useful as a marker in linkage analysis for chromosome 6.

This gene is expressed primarily in T cell, prostate and prostate cancer, endothelial cells and to a lesser extent in monocyte, dendritic cell, bone marrow, salivary gland, colon cancer, stomach cancer, pancreatic tumor, uterine cancer, fetal spleen and osteoclastoma.

Therefore, polynucleotides and polypeptides of the invention are useful as reagents for differential identification of the tissue(s) or cell type(s) present in a biological sample and for diagnosis of diseases and conditions: immuno-related diseases and cancers. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues and cell types (e.g., blood cells, prostate, endothelial cells, dendritic cells, bone marrow, salivary gland, colon, stomach, pancreas, uterus, spleen and bone, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for treatment of cancers. Similarly, the tissue distribution within T-cells, dendritic cells, and bone marrow suggests that the protein product of this clone would be useful for the treatment and diagnosis of hematopoetic related disorders such as anemia, pancytopenia, leukopenia, thrombocytopenia or leukemia since stromal cells are important in the production of cells of hematopoietic lineages. The uses include bone marrow cell ex vivo culture, bone marrow transplantation, bone marrow reconstitution, radiotherapy or chemotherapy of neoplasia. The gene product may also be involved in lymphopoiesis, therefore, it can be used in immune disorders such as infection, inflammation, allergy, immunodeficiency etc. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:159 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2381 of SEQ ID NO:159, b is an integer of 15 to 2395, where both a and b correspond to the positions of nucleotide residues shown in SEQ ID NO:159, and where the b is greater than or equal to a+14.

Features of Protein Encoded by Gene No: 150

This gene was recently cloned by another group, calling it eIF3-p66. (See Accession No. 2351378.) This gene plays a role in RNA binding and macromolecular assembly, and therefore, any mutations in this gene would likely result in a diseased phenotype. Preferred polypeptide fragments comprise the amino acid sequence: MAKFMTPVIQDNPSG-WGPCAVPEQFRDMPYQPFSKGDRLGK-VADWTGATYQDKRYTN KYSSQFGGGSQYAYFHEEDESSFQLVD-TARTQKTAYQRNRMRFAQRNLRRDKDRRNML QFN-LQILPKSAKQKERERIRLQKKFQKQF-GVRQKWDQKSQKPRDSSVEVRSDWEVKEEM DFPQLMKMRYLEVSEPQDIECCGALEYY-DKAFDRITTRSEKPLRXXKRIFHTVTTTDDPVI RKLAKTQGNVFATDAILATLMSCTRS-VYSWDIVVQRVGSKLFFDKRDNSDFDLLTVSETA NEPPQDEGNSFNSPRNLAMEATYINHNF-SQQCLRMGKERYNFPNPNPFVEDDMDKNEIA SVAYRYRSGKLGDDIDLIVRCEHDGVMT-GANGEVSFINIKTLNEWDSRHCNGVDWRQKL DSQR-GAVIATELKNNSYKLARWTCCALLAG-SEYLKLGYVSRYHVKDSSRHVILGTQQFK PNEFASQINLSVENAWGILRCVIDIC-MKLEEGKYLILKDPNKQVIRVYSLPDGTFSS (SEQ ID NO:732), or CQSHLSRLGASEANEDAWRNAVTD-FRVDLRFTAREFFRPTQRKRESSLRQRRSC LRRRPL-RAHVSSFPGFSRVLLLTRSPARTICCH-PGRPRHCRFWK (SEQ ID NO:733), as well as N-terminal and C-terminal deletions of this polypeptide fragment.

This gene is expressed primarily in T cell, bone marrow, embryo and endothelial cells and to a lesser extent in testis tumor and endometrial tumor.

Therefore, polynucleotides and polypeptides of the invention are useful as reagents for differential identification of the tissue(s) or cell type(s) present in a biological sample and for diagnosis of diseases and conditions: immune disorders, particularly inflammatory or immunodeficiecy disorders, and tumors. Similarly, polypeptides and antibodies directed to these polypeptides are useful in providing immunological probes for differential identification of the tissue(s) or cell type(s). For a number of disorders of the above tissues or cells, particularly of the immune system and reproductive system, expression of this gene at significantly higher or lower levels may be routinely detected in certain tissues and cell types (e.g. immune, developmental, hematopoietic, and cancerous and wounded tissues) or bodily fluids (e.g. lymph, amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for immune disorders and cancers. Similarly, expression within embryonic tissue and other cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Preferred epitopes include those comprising a sequence shown in SEQ ID NO.469 as residues: Gln-10 to Trp-16, Pro-32 to Leu-39, Tyr-50 to Gln-68, Ala-86 to Phe-100, Arg-103 to Asn-113, Ser-125 to Arg-133, Gln-137 to Lys-142, Arg-147 to Ser-161, Arg-165 to Glu-173, Ile-209 to Arg-218.

Many polynucleotide sequences, such as EST sequences, are publicly available and accessible through sequence databases. Some of these sequences are related to SEQ ID NO:160 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2106 of SEQ ID NO:160, b is an integer of 15 to 2120, where both a and b correspond to the positions of nucleotide residues shown in SEQ ID NO:160, and where the b is greater than or equal to a+14.

Features of Protein Encoded by Gene No: 151

The translation product of this gene was found to have homology to the human VRK1 and VRK2 proteins (See Genbank Accession No. gi|1827450 (AB000449), and gi|1827452 (AB000450), respectively) which are thought to encode novel serine/threonine kinases. Based upon the role of such proteins in regulation of various cellular processes, namely regulation of cellular proliferation, an important function for this clone would be realized by a skilled artisan. In specific embodiments, polypeptides of the invention comprise the following amino acid sequence: KLKS-FQTRDNQGILYEAAPTSTLTCXSG-PQKQKFSLKLDAKDGRLFNEQNFFQRAAKPLQ VNK-WKKLYSTPLLAIPTCMGFGVHQDKYRFLVLPSLGRSL QSALDVSPKHVLCREVCAAGGLPAAGCPGVPP (SEQ ID NO:734). Polynucleotides encoding these polypeptides are also encompassed by the invention.

This gene is expressed primarily in testes and to a lesser extent in T cell, spinal cord, placenta, neutrophil and monocyte.

Therefore, polynucleotides and polypeptides of the invention are useful as reagents for differential identification of the tissue(s) or cell type(s) present in a biological sample and for diagnosis of diseases and conditions: male reproductive and endocrine disorders. Similarly, polypeptides and antibodies directed to these polypeptides are useful in providing immunological probes for differential identification of the tissue(s) or cell type(s). For a number of disorders of the above tissues or cells, particularly of the reproductive, immune and endocrine systems, expression of this gene at significantly higher or lower levels may be routinely detected in certain tissues and cell types (e.g., testis and other reproductive tissue, blood cells, tissue of the nervous system, and placenta, and cancerous and wounded tissues) or bodily fluids (e.g. lymph, seminal fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for regulating immune and reproductive functions. Protein, as well as, antibodies directed against the protein may show utility as a tumor marker and/or immunotherapy targets for the above listed tissues.

Preferred epitopes include those comprising a sequence shown in SEQ ID NO.470 as residues: Lys-2 to Trp-24, Arg-35 to Gly-40, Lys-46 to Cys-58, Arg-71 to Trp-77, Glu-164 to Gly-172.

Many polynucleotide sequences, such as EST sequences, are publicly available and accessible through sequence databases. Some of these sequences are related to SEQ ID NO:161 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 886 of SEQ ID NO:161, b is an integer of 15 to 900, where both a and b correspond to the positions of nucleotide residues shown in SEQ ID NO:161, and where the b is greater than or equal to a+14.

Features of Protein Encoded by Gene No: 152

The translation product of this gene shares sequence homology with tyrosyl-tRNA synthetase which is thought to be important in cell growth.

This gene is expressed primarily in brain, liver, keratinocytes, tonsils, and heart.

Therefore, polynucleotides and polypeptides of the invention are useful as reagents for differential identification of the tissue(s) or cell type(s) present in a biological sample and for diagnosis of diseases and conditions which include, but are not limited to, cancer and/or autoimmune diseases. Similarly, polypeptides and antibodies directed to these polypeptides are useful in providing immunological probes for differential identification of the tissue(s) or cell type(s). For a number of disorders of the above tissues or cells, particularly of the brain, liver, keratinocytes, tonsils and heart, expression of this gene at significantly higher or lower levels may be routinely detected in certain tissues and cell types (e.g., brain and other tissues of the nervous system, liver, keratinocytes, tonsils and heart, immune, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to tyrosyl-tRNA synthetase indicate that polynucleotides and polypeptides corresponding to this gene are useful for modulating cell growth. Protein, as well as, antibodies directed against the protein may show utility as a tumor marker and/or immunotherapy targets for the above listed tissues.

Preferred epitopes include those comprising a sequence shown in SEQ ID NO.471 as residues: Thr-2 to Glu-17, Cys-74 to Ser-79.

Many polynucleotide sequences, such as EST sequences, are publicly available and accessible through sequence databases. Some of these sequences are related to SEQ ID NO:162 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 989 of SEQ ID NO:162, b is an integer of 15 to 1003, where both a and b correspond to the positions of nucleotide residues shown in SEQ ID NO:162, and where the b is greater than or equal to a+14.

Features of Protein Encoded by Gene No: 153

This gene is homologous to the Drosophila transcriptional regulator dre4. (See Genbank Accession No. 2511745. ) Dre4 is a gene required for steroidogenesis in Drosophila melanogaster and encodes a developmentally expressed homologue of the yeast transcriptional regulator CDC68. Preferred polypeptide fragments comprise the amino acid sequence: KKRHTDVQFYTEVGEITTDLGKHQHMH-DRDDLYAEQMEREMRHKLKTAFKNFIEKVEA LTKEELEFEVPFRDLGFNGAPYRST-CLLQPTSSALVNATEWPPFVVTLDEVELIHFXRVQF HLKNFDMVIVYKDYSKKVTMI-NAIPVASLDPIKEWLN-SCDLKYTEGVQSLNWTKIMKTIV DDPEGFFEQGG-WSFL (SEQ ID NO:735), as well as N-terminal and C-terminal deletions of this fragments. Also preferred are polynucleotide fragments encoding this polypeptide fragment.

This gene is expressed primarily in fetal liver, spleen, placenta, lung, T cell, thyroid, testes.

Therefore, polynucleotides and polypeptides of the invention are useful as reagents for differential identification of the tissue(s) or cell type(s) present in a biological sample and for diagnosis of diseases and conditions: brain tumor, heart and liver diseases. Similarly, polypeptides and antibodies directed to these polypeptides are useful in providing immunological probes for differential identification of the tissue(s) or cell type(s). For a number of disorders of the above tissues or cells, particularly of the fetal liver, spleen, placenta, lung, T cell, thyroid and testes, expression of this gene at significantly higher or lower levels may be routinely detected in certain tissues and cell types (e.g., liver, spleen, placenta, lung, blood cells, thyroid, and testes and other reproductive tissue, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in fetal liver, spleen , T-cells, and thyroid suggests that the protein product of this clone would be useful for the diagnosis and treatment of a variety of immune system disorders. Expression of this gene product in immune cells suggests a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:163 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2182 of SEQ ID NO:163, b is an integer of 15 to 2196, where both a and b correspond to the positions of nucleotide residues shown in SEQ ID NO:163, and where the b is greater than or equal to a+14.

Features of Protein Encoded by Gene No: 154

The translation product of this gene was found to have homology to both the human cAMP-dependent protein kinase and phospholemman chloride channel, which are thought to be involved in regulation of signal transduction pathways, potentially for cell cycle regulation (See Genbank Accession No. pir|A40533|A40533 and gi|1916010, respectively). The gene encoding the disclosed cDNA is believed to reside on chromosome 11. Accordingly, polynucleotides related to this invention are useful as a marker in linkage analysis for chromosome 11.

This gene is expressed primarily in brain and to a lesser extent in fetal heart, testis, spleen, lung.

Therefore, polynucleotides and polypeptides of the invention are useful as reagents for differential identification of the tissue(s) or cell type(s) present in a biological sample and for diagnosis of diseases and conditions: heart, liver and spleen diseases, immunological diseases. Similarly, polypeptides and antibodies directed to these polypeptides are useful in providing immunological probes for differential identification of the tissue(s) or cell type(s). For a number of disorders of the above tissues or cells, particularly of the brain, fetal heart, testis, spleen and lung, expression of this gene at significantly higher or lower levels may be routinely detected in certain tissues and cell types (e.g., brain and other tissue of the nervous system, heart, testes and other reproductive tissue, spleen, and lung, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in brain combined with the homology to the conserved cAMP-dependent protein kinase and phospholemman proteins suggests that the protein product of this clone would be useful for the detection/treatment of neurodegenerative disease states, behavioural disorders, or inflammatory conditions such as Alzheimers Disease, Parkinsons Disease, Huntingtons Disease, Tourette Syndrome, meningitis, encephalitis, demyelinating diseases, peripheral neuropathies, neoplasia, trauma, congenital malformations, spinal cord injuries, ischemia and infarction, aneurysms, hemorrhages, schizophrenia, mania, dementia, paranoia, obsessive compulsive disorder, panic disorder, learning disabilities, ALS, psychoses, autism, and altered bahaviors, including disorders in feeding, sleep patterns, balance, and preception. In addition, the gene or gene product may also play a role in the treatment and/or detection of developmental disorders associated with the developing embryo, sexually-linked disorders, or disorders of the cardiovascular system.

Alternatively, expression within fetal tissues and other cellular sources marked by proliferating cells suggests that this protein may play a role in the regulation of cellular division, and may show utility in the diagnosis and treatment of cancer and other proliferative disorders. Similarly, embryonic development also involves decisions involving cell differentiation and/or apoptosis in pattern formation. Thus this protein may also be involved in apoptosis or tissue differentiation and could again be useful in cancer therapy. Protein, as well as, antibodies directed against the protein may show utility as a tumor marker and/or immunotherapy targets for the above listed tissues.

Preferred epitopes include those comprising a sequence shown in SEQ ID NO.473 as residues: Glu-22 to Phe-30, Arg-59 to Ala-77, Ala-87 to Asn-95.

Many polynucleotide sequences, such as EST sequences, are publicly available and accessible through sequence databases. Some of these sequences are related to SEQ ID NO:164 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1931 of SEQ ID NO:164, b is an integer of 15 to 1945, where both a and b correspond to the positions of nucleotide residues shown in SEQ ID NO:164, and where the b is greater than or equal to a+14.

Features of Protein Encoded by Gene No: 155

Activation of T cells through the T cell antigen receptor (TCR) results in the rapid tyrosine phosphorylation of a number of cellular proteins, one of the earliest being a 100 kDa protein. This gene is the human equivalent of murine valosin containing protein (VCP). VCP is a member of a family of ATP binding, homo-oligomeric proteins, and the mammalian homolog of Saccharomyces cerevisiae cdc48p, a protein essential to the completion of mitosis in yeast. Both endogenous and expressed murine VCP are tyrosine phosphorylated in response to T cell activation. Thus we have identified a novel component of the TCR mediated tyrosine kinase activation pathway that may provide a link between TCR activation and cell cycle control. In specific embodiments, polypeptides of the invention comprise the following amino acid sequence: MASGADSKGDDL-STAILKQKN RPNRLIVDEAINEDN (SEQ ID NO:736), GKKRREAVCIVLSDDTCSDEKIRM (SEQ ID NO: 737), GDVISIQPCPDVKYGKRIHVLPID (SEQ ID NO:738), ITGNLFEVYL KPYFLEAYRPIRKGDIFLVRGGMRA (SEQ ID NO:739), GYDDIGGCRKQLAQIKE MVELPL-RHPALFKAI (SEQ ID NO:740), PPGTGKTLIARAV-ANETGAFFFLINGPEI MSKLAGES (SEQ ID NO:741), RRIVSQLLTLMDGLKQRAHVIVMAATNRPNSIDP A (SEQ ID NO:742), VDIGIPDATGRLEILQIHTKN-MKLADDVD (SEQ ID NO:743), EAALQAIRKKM-DLIDLEDETI (SEQ ID NO:744), TVVEVPQVTWED-IGGLEDVKREL QELVQYPVEHPD (SEQ ID NO:745), NECQANFISIKGPELLTMWFGESEANVREIF DKAR (SEQ ID NO:746), ILTEMDGMSTKKNVFIIGATNRPDI-IDPAI (SEQ ID NO:747), IYIPLPDEKSRVAILKANLRK-SPVAKDVDLEFL (SEQ ID NO:748), DPVPEIRR DHFEEAMRFARRSVSDNDI (SEQ ID NO:749), QTLQQSRGFGSFRFP (SEQ ID NO:750), or CGPGTV-ANETHGHVGADLAALCSEAALQAIRKKM-DLIDLEDETIDAEVMN SLAVTMDDFRWALSQSNP-SALRETVVEVPQVTWEDIGGLEDVKRELQELVQYP VEHPDKF LKFGMTPSKGVLFYGPPGCGKTLLAKA-IANECQANFISIKGPELLTMWFG ESEANVREIFDKAR-QAAPCVLFFDELDSIAKARGGNIGDGG-GAADRVINQILTEMDGMST KKNVFIIGATNRPDIIDPAILR-PGRLDQLIYIPLPDEKSRVAILKANLRKSPVA KDVDLEFLAKMTNGFSGADLTEIC-QRACKLAIRESIESEIRRERERQTNPSAMEVEEDDPVP EIRRDHFEEAMRFARRSVSDNDIRKYEM-FAQTLQQSRGFGSFRFPSGNQG GAGPSQGSGGGTGGSVYTEDNDDDLYG (SEQ ID NO:751). Polynucleotides encoding these polypeptides are also encompassed by the invention. The gene encoding the disclosed cDNA is believed to reside on chromosome 9. Accordingly, polynucleotides related to this invention are useful as a marker in linkage analysis for chromosome 9.

This gene is expressed primarily in brain, liver, spleen, placenta.

Therefore, polynucleotides and polypeptides of the invention are useful as reagents for differential identification of the tissue(s) or cell type(s) present in a biological sample and for diagnosis of diseases and conditions which include, but are not limited to, cancer and immunological disorders. Similarly, polypeptides and antibodies directed to these polypeptides are useful in providing immunological probes for differential identification of the tissue(s) or cell type(s). For a number of disorders of the above tissues or cells, particularly of the brain, liver, spleen, placenta expression of this gene at significantly higher or lower levels may be routinely detected in certain tissues and cell types (e.g., brain and other tissue of the nervous system, liver, spleen, and placenta, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to VCR indicate that polynucleotides and polypeptides corresponding to this gene are useful for treating cancer. The secreted protein can also be used to determine biological activity, to raise antibodies, as tissue markers, to isolate cognate ligands or receptors, to identify agents that modulate their interactions and as nutritional supplements. It may also have a very wide range of biological acitivities. Typical of these are cytokine, cell proliferation/differentiation modulating activity or induction of other cytokines; immunostimulating/immunosuppressant activities (e.g. for treating human immunodeficiency virus infection, cancer, autoimmune diseases and allergy); regulation of hematopoiesis (e.g. for treating anaemia or as adjunct to chemotherapy); stimulation or growth of bone, cartilage, tendons, ligaments and/or nerves (e.g. for treating wounds, stimulation of follicle stimulating hormone (for control of fertility); chemotactic and chemokinetic activities (e.g. for treating infections, tumors); hemostatic or thrombolytic activity (e.g. for treating haemophilia, cardiac infarction etc.); anti-inflammatory activity (e.g. for treating septic shock, Crohn's disease); as antimicrobials; for treating psoriasis or other hyperproliferative diseases; for regulation of metabolism, and behaviour. Also contemplated is the use of the corresponding nucleic acid in gene therapy procedures. Protein, as well as, antibodies directed against the protein may show utility as a tumor marker and/or immunotherapy targets for the above listed tissues.

Preferred epitopes include those comprising a sequence shown in SEQ ID NO.474 as residues: Ala-5 to Asp-11, Lys-18 to Asn-24, Asp-75 to Ile-82, Pro-106 to Lys-112, Arg-144 to Gly-149, Glu-187 to Ser-197, Gly-202 to Cys-209, Ser-282 to Lys-288, Glu-291 to Asn-296, Pro-311 to His-317, Thr-347 to Ser-352, Arg-359 to Val-367.

Many polynucleotide sequences, such as EST sequences, are publicly available and accessible through sequence databases. Some of these sequences are related to SEQ ID NO:165 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2919 of SEQ ID NO:165, b is an integer of 15 to 2933, where both a and b correspond to the positions of nucleotide residues shown in SEQ ID NO:165, and where the b is greater than or equal to a+14.

Features of Protein Encoded by Gene No: 156

The translation product of this gene shares sequence homology with rat growth response protein which is thought to be important in cell growth. A group recently cloned the human homolog of this gene, calling it insulin induced protein 1. (See Accession No. 2358269, see also, Genomics 43 (3), 278–284 (1997).) Preferred polypeptide fragments comprise the amino acid sequence: RSGLGLGITIAFLATL-ITQFLVYNGVYQYTSPDF LYIRSWLPCIFFSG-GVTVGNIGRQLAMGVPEKPHSD (SEQ ID NO:752), as well as N-terminal and C-terminal deletions of this polypeptide fragment. Also preferred are polynucleotide fragments encoding these polypeptide fragments. The gene encoding the disclosed cDNA is believed to reside on chromosome 7. Accordingly, polynucleotides related to this invention are useful as a marker in linkage analysis for chromosome 7.

This gene is expressed primarily in brain, liver, placenta, heart, spleen, lymphoma.

Therefore, polynucleotides and polypeptides of the invention are useful as reagents for differential identification of the tissue(s) or cell type(s) present in a biological sample and for diagnosis of diseases and conditions which include, but are not limited to, cancer and immunological disorders. Similarly, polypeptides and antibodies directed to these polypeptides are useful in providing immunological probes for differential identification of the tissue(s) or cell type(s). For a number of disorders of the above tissues or cells, particularly of the brain, liver, placenta, heart, spleen. expression of this gene at significantly higher or lower levels may be routinely detected in certain tissues and cell types (e.g., brain and other tissue of the nervous system, liver, placenta, heart, spleen, and lymphoid tissue, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in liver and homology to growth-response protein indicate that polynucleotides and polypeptides corresponding to this gene are useful for modulating cell growth and may play a role in growth and differentiation of tissues involved in metabolic control or development. Protein, as well as, antibodies directed against the protein may show utility as a tumor marker and/or immunotherapy targets for the above listed tissues.

Many polynucleotide sequences, such as EST sequences, are publicly available and accessible through sequence databases. Some of these sequences are related to SEQ ID NO:166 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2229 of SEQ ID NO:166, b is an integer of 15 to 2243, where both a and b correspond to the positions of nucleotide residues shown in SEQ ID NO:166, and where the b is greater than or equal to a+14.

Features of Protein Encoded by Gene No:157

The gene encoding the disclosed cDNA is believed to reside on chromosome 1. Accordingly, polynucleotides related to this invention are useful as a marker in linkage analysis for chromosome 1.

This gene is expressed primarily in Glioblastoma, endometrial tumor, lymphoma and pancreas tumor.

Therefore, polynucleotides and polypeptides of the invention are useful as reagents for differential identification of the tissue(s) or cell type(s) present in a biological sample and for diagnosis of diseases and conditions: Glioblastoma, Endometrial tumor, lymphoma and pancreas tumor, and other proliferative disorders. Similarly, polypeptides and antibodies directed to these polypeptides are useful in providing immunological probes for differential identification of the tissue(s) or cell type(s). For a number of disorders of the above tissues or cells, particularly of the immune, expression of this gene at significantly higher or lower levels may be routinely detected in certain tissues and cell types (e.g., endometrium, lymphoid tissue, pancreas, and tissue of the nervous system, and cancerous and wounded tissues) or bodily fluids (e.g. lymph, bile, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution in tumors of pancreas, endometrium, and other proliferative tissues suggests that the protein product of this clone would be useful for diagnosis and intervention of these tumors, in addition to other tumors where expression has been indicated. Protein, as well as, antibodies directed against the protein may show utility as a tissue-specific marker and/or immunotherapy target for the above listed tissues.

Preferred epitopes include those comprising a sequence shown in SEQ ID NO.476 as residues: Thr-60 to Glu-66, Tyr-104 to Tyr-104 to Tyr-111.

Many polynucleotide sequences, such as EST sequences, are publicly available and accessible through sequence databases. Some of these sequences are related to SEQ ID NO:167 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1802 of SEQ ID NO:167, b is an integer of 15 to 1816, where both a and b correspond to the positions of nucleotide residues shown in SEQ ID NO:167, and where the b is greater than or equal to a+14.

Features of Protein Encoded by Gene No: 158

The translation product of this gene shares sequence homology with IGE receptor which is thought to be important in allergy and asthma. In specific embodiments, polypeptides of the invention comprise the following amino acid sequence: ETRVKTSLELLRTQLEPTGTVGNTINF-SQAEKPEPTNQGQDSLKKHLHAEIKVI GTIQILCG (SEQ ID NO:753). Polynucleotides encoding these polypeptides are also encompassed by the invention.

This gene is expressed primarily in T cell, and fetal liver.

Therefore, polynucleotides and polypeptides of the invention are useful as reagents for differential identification of the tissue(s) or cell type(s) present in a biological sample and for diagnosis of diseases and conditions: allergy and asthma and other immunological disorders. Similarly, polypeptides and antibodies directed to these polypeptides are useful in providing immunological probes for differential identification of the tissue(s) or cell type(s). For a number of disorders of the above tissues or cells, particularly of the immune, expression of this gene at significantly higher or lower levels may be routinely detected in certain tissues and cell types (e.g. immune, blood cells, and liver, and cancerous and wounded tissues) or bodily fluids (e.g. lymph, amniotic fluid, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to IgE receptor indicate that polynucleotides and polypeptides corresponding to this gene are useful for allergy and asthma. Similarly, The secreted protein can also be used to determine biological activity, to raise antibodies, as tissue markers, to isolate cognate ligands or receptors, to identify agents that modulate their interactions and as nutritional supplements. It may also have a very wide range of biological activities. Typical of these are cytokine, cell proliferation/differentiation modulating activity or induction of other cytokines; immunostimulating/immunosuppressant activities (e.g. for treating human immunodeficiency virus infection, cancer, autoimmune diseases and allergy); regulation of hematopoiesis (e.g. for treating anaemia or as adjunct to chemotherapy); stimulation or growth of bone, cartilage, tendons, ligaments and/or nerves (e.g. for treating wounds, stimulation of follicle stimulating hormone (for control of fertility); chemotactic and chemokinetic activities (e.g. for treating infections, tumors); hemostatic or thrombolytic activity (e.g. for treating haemophilia, cardiac infarction etc.); anti-inflammatory activity (e.g. for treating septic shock, Crohn's disease); as antimicrobials; for treating psoriasis or other hyperproliferative diseases; for regulation of metabolism, and behaviour. Also contemplated is the use of the corresponding nucleic acid in gene therapy procedures. Protein, as well as, antibodies directed against the protein may show utility as a tumor marker and/or immunotherapy targets for the above listed tissues.

Preferred epitopes include those comprising a sequence shown in SEQ ID NO.477 as residues: Glu-94 to Thr-102.

Many polynucleotide sequences, such as EST sequences, are publicly available and accessible through sequence databases. Some of these sequences are related to SEQ ID NO:168 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 931 of SEQ ID NO:168, b is an integer of 15 to 945, where both a and b correspond to the positions of nucleotide residues shown in SEQ ID NO:168, and where the b is greater than or equal to a+14.

Features of Protein Encoded by Gene No: 159

The translation product of this gene shares sequence homology with immunoglobin heavy chain which is thought to be important in immune responses to antigens.

This gene is expressed primarily in activated neutrophil and to a lesser extent in activated T cell, monocytes, and heart.

Therefore, polynucleotides and polypeptides of the invention are useful as reagents for differential identification of the tissue(s) or cell type(s) present in a biological sample and for diagnosis of diseases and conditions: immune disorders, particularly infection, inflammation, and cancer. Similarly, polypeptides and antibodies directed to these polypeptides are useful in providing immunological probes for differential identification of the tissue(s) or cell type(s). For a number of disorders of the above tissues or cells, particularly of the immune, expression of this gene at significantly higher or lower levels may be routinely detected in certain tissues and cell types (e.g., blood cells, and heart, and cancerous and wounded tissues) or bodily fluids (e.g. lymph, serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to immunoglobin heavy chain variable region indicate that polynucleotides and polypeptides corresponding to this gene are useful for making ligands to block specific antigens which cause certain disease. Similarly, the tissue distribution in T-cells suggests that the protein product of this clone would be useful for the diagnosis and treatment of a variety of immune system disorders. Expression of this gene product in tonsils suggests a role in the regulation of the proliferation; survival; differentiation; and/or activation of potentially all hematopoietic cell lineages, including blood stem cells. This gene product may be involved in the regulation of cytokine production, antigen presentation, or other processes that may also suggest a usefulness in the treatment of cancer (e.g. by boosting immune responses). Since the gene is expressed in cells of lymphoid origin, the natural gene product may be involved in immune functions. Therefore it may be also used as an agent for immunological disorders including arthritis, asthma, immunodeficiency diseases such as AIDS, leukemia, rheumatoid arthritis, granulomatous disease, inflammatory bowel disease, sepsis, acne, neutropenia, neutrophilia, psoriasis, hypersensitivities, such as T-cell mediated cytotoxicity; immune reactions to transplanted organs and tissues, such as host-versus-graft and graft-versus-host diseases, or autoimmunity disorders, such as autoimmune infertility, lense tissue injury, demyelination, systemic lupus erythematosis, drug induced hemolytic anemia, rheumatoid arthritis, Sjogren's disease, scleroderma and tissues. In addition, this gene product may have commercial utility in the expansion of stem cells and committed progenitors of various blood lineages, and in the differentiation and/or proliferation of various cell types. Protein, as well as, antibodies directed against the protein may show utility as a tumor marker and/or immunotherapy targets for the above listed tissues.

Preferred epitopes include those comprising a sequence shown in SEQ ID NO.478 as residues: Leu-24 to Gln-35, Arg-59 to Pro-64, Glu-71 to His-78, Asp-89 to Gly-94, Pro-141 to Val-151, Thr-167 to Val-172, Ala-175 to Thr-180.

Many polynucleotide sequences, such as EST sequences, are publicly available and accessible through sequence databases. Some of these sequences are related to SEQ ID NO:169 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 888 of SEQ ID NO:169, b is an integer of 15 to 902, where both a and b correspond to the positions of nucleotide residues shown in SEQ ID NO:169, and where the b is greater than or equal to a+14.

Features of Protein Encoded by Gene No: 160

The translation product of this gene shares sequence homology with mouse X inactive specific transcript protein which is thought to be important in X chromosome inactivation.

This gene is expressed primarily in HSA172 cell and to a lesser extent in normal ovary tissue, ovarian cancer, frontal cortex and brain.

Therefore, polynucleotides and polypeptides of the invention are useful as reagents for differential identification of the tissue(s) or cell type(s) present in a biological sample and for diagnosis of diseases and conditions: ovarian tumor, schizophrenia and other neurological disorders. Similarly, polypeptides and antibodies directed to these polypeptides are useful in providing immunological probes for differential identification of the tissue(s) or cell type(s). For a number of disorders of the above tissues or cells, particularly of the immune and neural system, expression of this gene at significantly higher or lower levels may be routinely detected in certain tissues and cell types (e.g., ovary and other reproductive tissue, and brain and other tissue of the nervous system, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to X inactive specific transcript protein indicate that polynucleotides and polypeptides corresponding to this gene are useful for diagnosis and treatment of reproductive system tumors and CNS tumors.

Preferred epitopes include those comprising a sequence shown in SEQ ID NO.479 as residues: His-48 to Trp-56.

Many polynucleotide sequences, such as EST sequences, are publicly available and accessible through sequence databases. Some of these sequences are related to SEQ ID NO:170 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1869 of SEQ ID NO:170, b is an integer of 15 to 1883, where both a and b correspond to the positions of nucleotide residues shown in SEQ ID NO:170, and where the b is greater than or equal to a+14.

Features of Protein Encoded by Gene No: 161

This gene is expressed primarily in adipose cells and to a lesser extent in liver and prostate tissue.

Therefore, polynucleotides and polypeptides of the invention are useful as reagents for differential identification of the tissue(s) or cell type(s) present in a biological sample and for diagnosis of diseases and conditions: obesity and liver disorders. Similarly, polypeptides and antibodies directed to these polypeptides are useful in providing immunological probes for differential identification of the tissue(s) or cell type(s). For a number of disorders of the above tissues or cells, particularly of the adipose cell, expression of this gene at significantly higher or lower levels may be routinely detected in certain tissues and cell types (e.g., adipose cells, liver, and prostate, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for treatment of obesity and liver disorder.

This gene is believed to reside on chromosome 3. Polynucleotides related to this gene are useful, therefore, in linkage analysis for chromosome 3.

Many polynucleotide sequences, such as EST sequences, are publicly available and accessible through sequence databases. Some of these sequences are related to SEQ ID NO:171 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2086 of SEQ ID NO:171, b is an integer of 15 to 2100, where both a and b correspond to the positions of nucleotide residues shown in SEQ ID NO:171, and where the b is greater than or equal to a+14.

Features of Protein Encoded by Gene No: 162

The translation product of this gene shares sequence homology with yeast ubiquitin activating enzyme homolog which is thought to be important in protein posttraslation processing. Mammalian cells contain two distinct proteolytic pathways that are involved in different aspects of protein breakdown. One of these is ubiquitin-dependent, it is a major pathway in eukaryotes involved in the selective degradation of abnormal and short-lived proteins. Ubiquitin is a highly conserved 76 amino acid residue protein present in eukaryotic cells either free or covalently attached to a great variety of proteins.

The ubiquitin gene is one of the genes known to be stimulated during the apoptotic death program and ubiquitin of nuclear proteins might be involved in chromatin disorganization and oligonucleosomal fragmentation, which are among the key events occurring in apoptosis. Apoptosis, the classical type of programmed cell death, can be triggered in many cell types by widely diverse stimuli, for example, gamma rays at low doses can induce apoptosis in vitro in interphase human lymphocytes. In this type of apoptosis induction, activated gene expression is necessary for the fulfillment of the death program. It has been reported (Delic, J., et al., Mol. Cell Biol., 13:4875, 83 (1993)) that there is a relationship between ubiquitin gene expression or ubiquitination and gamma-irradiation-mediated apoptosis in normal circulating human lymphocytes. In this report it has been demonstrated that the ubiquitin MRNA level is increased as a consequence of the activation of ubiquitin gene transcription 15 to 90 minutes after initiation of apoptosis; specifically, in apoptotic cells, and not in all irradiated cells, nuclear proteins are highly ubiquitinated; and ubiquitin sequence-specific antisense oligonucleotide inhibition results in a decreased level of ubiquitinated nuclear proteins and considerably diminishes the proportion of cells exhibiting the apoptotic death pattern.

Perturbations of ubiquitin system can also induce a programmed necrotic response in plants such as leaf curling, vascular tissue alterations and necrotic lesions.

Ubiquitin can inhibit the cytotoxic properties of platelets and the production of oxygen metabolites by these cells. Moreover, this molecule is able to act as a proaggregating factor and seems of a great interest in pathologies involving defects in platelet aggregation. Ubiquitin also plays a role in the regulation of immunological disorders in which platelets seem to be implicated such as hymenoptera venom hypersensitivity and aspirin-sensitive asthma, since in both situations, ubiquitin is able to inhibit the cytotoxic function of platelets. Ubiquitin has also been shown to be increased in patients with Alzheimer's disease (Taddei, N., et al., Neurosci. Lett., 151:158–61 (1993)). This study concerned the amount of soluble ubiquitin in different cortical and subcortical regions of brains from patients with Alzheimer's disease compared to the amount in a normal brain. The soluble ubiquitin content was significantly higher in pathological tissue Once the polypeptides are being expressed intra-cellularly via gene therapy, they may be employed to provide a signal via the lymphocyte homing receptor thereby regulating lymphocyte trafficking. The growth hormone receptor also utilizes ubiquitin to signal ligands, and, therefore, the Ubiquitin Activating-like polypeptides may be employed to regulate activation of the growth receptor.

Ubiquitin Activating-like polypeptides may be employed to overcome many viral infections by overcoming the suppressed programmed cell death induced by these viruses, since programmed cell death may be one of the primary antiviral defense mechanisms of cells.

Ubiquitin Activating-like polypeptides may also be employed to treat immuno-suppression related disorders, such as AIDS, by targeting virus infected cells for cell death.

Ubiquitin Activating-like polypeptides may also be employed to inhibit the cytotoxic properties of platelets and the production of oxygen metabolites by platelets. These polypeptides may also be employed to regulate immunological disorders in which platelets seem to be involved, for example, hymenoptera venom hypersensitivity and aspirin-sensitive asthma.

Ubiquitin Activating-like polypeptides may also be employed to treat malignant transformation because proto-oncoproteins c-Mos and v-Jun are degraded in a ubiquitin-dependent manner.

Preferred epitopes include those comprising a sequence shown in SEQ ID NO.481 as residues: Lys-65 to Lys-72, Tyr-159 to Thr-169, Arg-176 to Pro-1 82, Glu-200 to Glu-214, Ala-228 to Asp-234, Ile-238 to Asp-250, Lys-271 to Pro-279, Val-287 to Gly-306, Asp-345 to Ser-350, Asn-419 to Lys-426, Glu-494 to Leu-506.

Many polynucleotide sequences, such as EST sequences, are publicly available and accessible through sequence databases. Some of these sequences are related to SEQ ID NO:172 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1916 of SEQ ID NO:172, b is an integer of 15 to 1930, where both a and b correspond to the positions of nucleotide residues shown in SEQ ID NO:172, and where the b is greater than or equal to a+14.

Features of Protein Encoded by Gene No: 163

This gene is expressed primarily in primary breast cancer and hemangiopericytoma and to a lesser extent in adult brain and cerebellum.

Therefore, polynucleotides and polypeptides of the invention are useful as reagents for differential identification of the tissue(s) or cell type(s) present in a biological sample and for diagnosis of diseases and conditions: breast cancer, leukemia and cerebellum disorders. Similarly, polypeptides and antibodies directed to these polypeptides are useful in providing immunological robes for differential identification of the tissue(s) or cell type(s). For a number of disorders of than in normal tissue. The primary structure of ubiquitin isolated from brain tissue affected by Alzheimer's degenerative processes was determined and resulted to be identical to normal human ubiquitin. This report suggests that an impairment of the process of intracellular, ubiquitin-dependent proteolysis might play an important role in the pathogenesis of this neurodegenerative disease.

Ubiquitin-proteasome system also plays a major role in specific processing and subsequent presentation of MHC class I-restricted antigens.

Maturation of the p105 NF-KB precursor into the active p50 subunit of the transcriptional activator also proceeds in a ubiquitin and proteasome-dependent manner. Furthermore, inhibitors to the proteasome block degradation of IkBa and thus prevent tumor necrosis factor alpha induced activation of NF-KB and its entry into the nucleus.

The unstable c-Jun, but not the stable v-Jun, is multi-ubiquitinated and degraded. The escape of the oncogenic v-Jun from ubiquitin-dependent degradation suggests a route to the malignant transformation. Another proto-oncoprotein, c-Mos, is also degraded by the ubiquitin system.

The human papilloma virus (HPV) derived E6 proteins stimulate ATP and ubiquitin dependent conjugation and degradation of p53, such a mechanism could explain the extremely low levels of p53 observed in HPV-transformed cervical carcinoma lines and propose a mechanism for the tumorigenicity of these onco-proteins.

Several cell surface receptors, including the lymphocyte homing receptor, growth hormone receptor, and growth factor receptor (PDGF, steel factor) were also found to be modified by ubiquitin.

This gene is expressed primarily in stromal cell and to a lesser extent in retina, human atrophic endometrium, colon carcinoma and myeloid progenitor cells.

Therefore, polynucleotides and polypeptides of the invention are useful as reagents for differential identification of the tissue(s) or cell type(s) present in a biological sample and for diagnosis of diseases and conditions: defects of stromal cell development, neuronal growth disorders and tumors. Similarly, polypeptides and antibodies directed to these polypeptides are useful in providing immunological probes for differential identification of the tissue(s) or cell type(s). For a number of disorders of the above tissues or cells, particularly of the immune and neural system, expression of this gene at significantly higher or lower levels may be routinely detected in certain tissues and cell types (e.g., retinal cells, endometrium, colon, and bone marrow, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to ubiquitin-activating enzyme homolog indicate that polynucleotides and polypeptides corresponding to this gene are useful for diagnosis or treatment of some type of tumors, fucosidosis and neuronal growth disorders. the above tissues or cells, particularly of the immune system and neural system, expression of this gene at significantly higher or lower levels may be routinely detected in certain tissues and cell types (e.g., mammary tissue, brain and other tissue of the nervous system, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for diagnosis or treatment of various tumors and disease involved in neural system.

This gene is believed to reside on chromosome 3. Polynucleotides related to this gene are believed to be useful, therefore, in linkage analysis as markers for chromosome 3.

Preferred epitopes include those comprising a sequence shown in SEQ ID NO.482 as residues: Glu-29 to Tyr-42, Glu-44 to Glu-54, Tyr-68 to Glu-73, Ala-145 to Leu-165, Gln-173 to Ser-183, Lys-215 to Cys-220.

Many polynucleotide sequences, such as EST sequences, are publicly available and accessible through sequence databases. Some of these sequences are related to SEQ ID NO:173 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1495 of SEQ ID NO:173, b is an integer of 15 to 1509, where both a and b correspond to the positions of nucleotide residues shown in SEQ ID NO:173, and where the b is greater than or equal to a+14.

Features of Protein Encoded by Gene No: 164

The translation product of this gene, "MAX.3", shares sequence homology with proline rich proteins. Recently, another group has also cloned this gene, calling it CD84 leukocyte antigen, a new member of the Immunoglobulin superfamily. MAX.3 detects the CD84 antigen, which is a member of the CD2 family of cell surface molecules, and it is postulated that it is this interaction which allows MAX.3 to function in intracellular signaling events. (See Accession No. U82988, see also, Blood 90 (6), 2398–2405 (1997), incorporated herein by reference.) The extracellular domain is believed to comprise residues 23–220, the transmembrane domain residues 221–245 and the intracellular domain residues 246–389, of SEQ ID NO:483. Preferred polypeptides of the invention comprise the extracellular domain alone, residues 23–220, or fused to the intracellular domain; i.e., lacking the transmembrane domain.

This gene is expressed primarily in Weizmann olfactory tissue and osteoclastoma and to a lesser extent in anergic T-cells.

Therefore, polynucleotides and polypeptides of the invention are useful as reagents for differential identification of the tissue(s) or cell type(s) present in a biological sample and for diagnosis of diseases and conditions: ostsis and immune disease. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues and cell types (e.g., olfactory tissue, bone, and blood cells, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to the Ig superfamily CD84 antigen indicate that the protein product of this clone is useful for treatment of osteoporosis, autoimmune disease, and other immune disorders. Alternatively, the tissue distribution and homology to a cell-surface antigen may indicate that MAX.3 plays a role in the extracellular matrix remodelling and/or wound healing immune responses in the body.

Preferred epitopes include those comprising a sequence shown in SEQ ID NO.483 as residues: Ala-19 to Ser-24, Glu-102 to Ile-111, Thr-113 to Tyr-124, Glu-158 to Asn-167, Thr-183 to Leu-189, Asn-197 to Ser-207, Lys-250 to Thr-260, Arg-269 to Ile-278, Pro-289 to Pro-294, Ala-311 to Ser-323.

Many polynucleotide sequences, such as EST sequences, are publicly available and accessible through sequence databases. Some of these sequences are related to SEQ ID NO:174 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 3159 of SEQ ID NO:174, b is an integer of 15 to 3173, where both a and b correspond to the positions of nucleotide residues shown in SEQ ID NO:174, and where the b is greater than or equal to a+14.

Features of Protein Encoded by Gene No: 166

This gene is expressed primarily in human primary breast cancer and to a lesser extent in activated monocyte. This polypeptide is a type Ia transmembrane protein. The extracellular domain is believe to comprise residues from about 20–195, the transmembrane domain residues from about 196 to about 212, and the cytoplamic tail residues from about 213 to about 217, of SEQ ID NO:485. Preferred polypeptide fragments comprise the amino acid sequence: VTQPKHL-SASMGGSVEIPFSFYYPWELAXXPX-VRISWRRGHFHG QSFYSTRPPSIHKDYVNRLFLNW-TEGQESGFLRISNLRKEDQSVYFCRVELDTRRSG (SEQ ID NO:754), as well as N-terminal and C-terminal deletions. Also preferred are polypeptides comprising the extracellular domain, residues 20 to 195. Also provided are polynucleotide fragments encoding these polypeptides.

Therefore, polynucleotides and polypeptides of the invention are useful as reagents for differential identification of the tissue(s) or cell type(s) present in a biological sample and for diagnosis of diseases and conditions: breast cancer. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues and cell types (e.g., mammary tissue, and blood cells, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for diagnosis of breast cancer and other immune system disorders.

Many polynucleotide sequences, such as EST sequences, are publicly available and accessible through sequence databases. Some of these sequences are related to SEQ ID NO:176 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1276 of SEQ ID NO:176, b is an integer of 15 to 1290, where both a and b correspond to the positions of nucleotide residues shown in SEQ ID NO:176, and where the b is greater than or equal to a+14.

Features of Protein Encoded by Gene No: 167

This gene is expressed primarily in fetal tissues and to a lesser extent in adult lung. This gene has also been mapped to chromosomal location 9q34, and thus, can be used as a marker for linkage analysis for chromosome 9.

Therefore, polynucleotides and polypeptides of the invention are useful as reagents for differential identification of the tissue(s) or cell type(s) present in a biological sample. Similarly, polypeptides and antibodies directed to these polypeptides are useful in providing immunological probes for differential identification of the tissue(s) or cell type(s). For a number of disorders of the above tissues or cells, particularly of the embryo tissues, expression of this gene at significantly higher or lower levels may be routinely detected in certain tissues and cell types (e.g., fetal tissues, and lung, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful as reagents for differential identification of tissues or cell types present in a biological sample.

Preferred epitopes include those comprising a sequence shown in SEQ ID NO.486 as residues: Tyr-15 to Gly-23.

Many polynucleotide sequences, such as EST sequences, are publicly available and accessible through sequence databases. Some of these sequences are related to SEQ ID NO:177 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2276 of SEQ ID NO:177, b is an integer of 15 to 2290, where both a and b correspond to the positions of nucleotide residues shown in SEQ ID NO:177, and where the b is greater than or equal to a+14.

Features of Protein Encoded by Gene No: 168

The translation product of this gene shares sequence homology with Ig Heavy Chain which is thought to be important in immune response.

This gene is expressed primarily in prostate cancer tissue specifically

Therefore, polynucleotides and polypeptides of the invention are useful as reagents for differential identification of the tissue(s) or cell type(s) present in a biological sample and for diagnosis of diseases and conditions: prostate cancer. Similarly, polypeptides and antibodies directed to these polypeptides are useful in providing immunological probes for differential identification of the tissue(s) or cell type(s). For a number of disorders of the above tissues or cells, particularly of the prostate, expression of this gene at significantly higher or lower levels may be routinely detected in certain tissues and cell types (e.g., prostate, tissue and cells of the immune system, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for diagnosis of prostate cancer and other immune system disorders.

Many polynucleotide sequences, such as EST sequences, are publicly available and accessible through sequence databases. Some of these sequences are related to SEQ ID NO:178 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 535 of SEQ ID NO:178, b is an integer of 15 to 549, where both a and b correspond to the positions of nucleotide residues shown in SEQ ID NO:178, and where the b is greater than or equal to a+14.

Features of Protein Encoded by Gene No: 169

The translation product of this gene shares sequence homology with cytosolic acyl coenzyme-A hydrolase, which is thought to be important in neuron-specific fatty acid metabolism. The gene represented by this contig has since been published by Hajra and colleagues (GenBank Accession No. U91316, incorporated herein by reference).

This gene is expressed primarily in human pituitary gland and to a lesser extent in colorectal cancer tissue. This gene has also been observed in the LNCAP cell line.

Therefore, polynucleotides and polypeptides of the invention are useful as reagents for differential identification of the tissue(s) or cell type(s) present in a biological sample and for diagnosis of diseases and conditions: hyperlipidemias of familial and/or idiopathic origins. Similarly, polypeptides and antibodies directed to these polypeptides are useful in providing immunological probes for differential identification of the tissue(s) or cell type(s). For a number of disorders of the above tissues or cells, particularly blood, expression of this gene at significantly higher or lower levels may be routinely detected in certain tissues and cell types (e.g., pituitary and colon, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to rat cytosolic acyl coenzyme-A hydrolase indicate that polynucleotides and polypeptides corresponding to this gene are useful for the detection or treatment of hyperlipidemia disease states by virtue of the ability of specific drugs to activate the enzyme.

Preferred epitopes include those comprising a sequence shown in SEQ ID NO.488 as residues: Arg-48 to Glu-56.

Many polynucleotide sequences, such as EST sequences, are publicly available and accessible through sequence databases. Some of these sequences are related to SEQ ID NO:179 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1495 of SEQ ID NO:179, b is an integer of 15 to 1509, where both a and b correspond to the positions of nucleotide residues shown in SEQ ID NO:179, and where the b is greater than or equal to a+14.

Features of Protein Encoded by Gene No: 170

The translation product of this gene shares sequence homology with a *Caenorhabditis elegans* gene which is thought to be important in organism development. This gene is believed to be important in embryogenesis and cancer.

Preferred polypeptide encoded by this gene comprise the following amino acid sequence: MATPAVPVSAPPATPT-PVPAAAPASVPAPTPAPAAAPVPAAAPACILRPC GSS-GCNCGSWPDPGLSAXPAQTPAPALPG-PALPGPFPGGRVVRLHPVILAIVDSY ERRNEGAARVIGTLLGTVDKHSVEVT-NCFSVPHNESEDEVAVDMEFAKNMYELHKKVSP NELILGWYATGHDITEHSVLIHEYYS-REAPNPIHLTVDTSLQNGRMSIKAYVSTLMGVPGR TMGVMFTPLTVKYAYYDTERIGVDLIMK-TCFSPNRVIGLSSDLQQVGGASARIQDALSTVL QYAEDVLSGKVSADNTVGRFLMSLVN-QVPKIVPDDFETMLNSNINDLLMVTYLANLTQSQ IALNEKLVNL (SEQ ID NO:755) and MLNSNINDLLM-VTYLANLTQSQLALNEKLVNL (SEQ ID NO:756). Polynucleotides encoding such polypeptides are also provided.

This gene is expressed primarily in human synovial sarcoma tissue, bone marrow, and to a lesser extent in human brain.

Therefore, polynucleotides and polypeptides of the invention are useful as reagents for differential identification of the tissue(s) or cell type(s) present in a biological sample and for diagnosis of diseases and conditions which include, but are not limited to, bone, specifically synovial sarcoma. Similarly, polypeptides and antibodies directed to these polypeptides are useful in providing immunological probes for differential identification of the tissue(s) or cell type(s). For a number of disorders of the above tissues or cells, particularly of the bone, connective tissues and possibly immune system, expression of this gene at significantly higher or lower levels may be routinely detected in certain tissues and cell types (e.g., synovial tissue, bone marrow, brain and other tissue of the nervous system, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to *Caenorhabditis elegans* indicate that polynucleotides and polypeptides corresponding to this gene are useful as a diagnostic and/or therapeutic modality directed at the detection and/or treatment of connective tissue sarcomas or other related bone diseases.

Many polynucleotide sequences, such as EST sequences, are publicly available and accessible through sequence databases. Some of these sequences are related to SEQ ID NO:180 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1302 of SEQ ID NO:180, b is an integer of 15 to 1316, where both a and b correspond to the positions of nucleotide residues shown in SEQ ID NO:180, and where the b is greater than or equal to a+14.

Features of Protein Encoded by Gene No: 171

The translation product of this gene shares sequence homology with beta1-6GlcNAc transferase which is thought to be important in the transfer and metabolism of beta1 -6, N-acetylglucosamine. This gene product has previously been shown to suppress melanoma lung metastasis in both syngeneic and nude mice, decreased invasiveness into the matrigel, and inhibition of cell attachment to collagen and laminin without affecting cell growth.

This gene is expressed primarily in human testes and prostate tissues, and to a lesser extent in kidney, medulla, and pancreas.

Therefore, polynucleotides and polypeptides of the invention are useful as reagents for differential identification of the tissue(s) or cell type(s) present in a biological sample and for diagnosis of diseases and conditions which include, but are not limited to, cancer particularly melanoma. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues and cell types (e.g., testes and other reproductive tissue, prostate, kidney, pancreas, brain and other tissue of the nervous system, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to beta1-6GlcNAc transferase indicate that the protein product of this clone is useful for the development of diagnostic and/or therapeutic modalities directed at the detection and/or treatment of cancer, the metastasis of malignant tissue or cells. Defects in this potentially secreted enzyme may play a role in metastasis.

Many polynucleotide sequences, such as EST sequences, are publicly available and accessible through sequence databases. Some of these sequences are related to SEQ ID NO:181 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 763 of SEQ ID NO:181, b is an integer of 15 to 777, where both a and b correspond to the positions of nucleotide residues shown in SEQ ID NO:181, and where the b is greater than or equal to a+14.

Features of Protein Encoded by Gene No: 172

This gene is expressed primarily in fetal spleen and liver.

Therefore, polynucleotides and polypeptides of the invention are useful as reagents for differential identification of the tissue(s) or cell type(s) present in a biological sample and for diagnosis of diseases and conditions: immune disorders, Wilm's tumor disease, hepatic disorders, and hematopoietic disorders. Similarly, polypeptides and antibodies directed to these polypeptides are useful in providing immunological probes for differential identification of the tissue(s) or cell type(s). For a number of disorders of the above tissues or cells, particularly of the hematopoiesis and immune systems, expression of this gene at significantly higher or lower levels may be routinely detected in certain tissues and cell types (e.g., spleen and liver, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that polynucleotides and polypeptides corresponding to this gene are useful for the treatment and identification of fetal defects along with correcting diseases that affect hematopoiesis and the immune system.

This gene is believed to reside on chromosome 6. Therefore, nucleic acids related to this gene are useful in linkage analysis as markers for chromosome 6.

Many polynucleotide sequences, such as EST sequences, are publicly available and accessible through sequence databases. Some of these sequences are related to SEQ ID NO:182 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 777 of SEQ ID NO:182, b is an integer of 15 to 791, where both a and b correspond to the positions of nucleotide residues shown in SEQ ID NO:182, and where the b is greater than or equal to a+14.

Features of Protein Encoded by Gene No: 173

The translation product of this gene shares sequence homology with ret II oncogene which is thought to be important in Hirschsprung disease and many types of cancers.

This gene is expressed in multiple tissues including the lymphatic system, brain, and thyroid.

Therefore, polynucleotides and polypeptides of the invention are useful as reagents for identification of the tissue(s) or cell type(s) present in a biological sample and for diagnosis of diseases and conditions: Hirschsprung disease and multiple cancers. Similarly, polypeptides and antibodies directed to these polypeptides are useful in providing immunological probes for identification of the tissue(s) or cell type(s). For a number of disorders of the above tissues or cells, particularly of the immune and central nervous system, expression of this gene at significantly higher or lower levels may be routinely detected in certain tissues and cell types (e.g., lymphoid tissue, thyroid, and brain and other tissue of the nervous system, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to ret II oncogene indicate that polynucleotides and polypeptides corresponding to this gene are useful for diagnosis and treatment of various cancers. It would also be useful for the diagnosis and treatment of Hirschsprung disease. Preferred polypeptides of the invention comprise the amino acid sequence: MEAQQVNEAESAREQLQXLHD-QIAGQKASKQELETELERLKQEFHYIEE DLYRT-KNTLQSRIKDRDEEIQKLRNQLTNKTL-SNSSQSELENRLHQLTETLIQKQTMLESL STEKNSLVFQLERLEQQMNSASGSSS-NGSSINMSGIDNGEGTRLRNVPVLFNDTETNLAG MYGKVRKAASSIDQFSIRLGIFLRRYPI-ARVFVIIYMALLHLWVMIVLLTYTPEMHHDQPY GK (SEQ ID NO:757). Polynucleotides encoding such polypeptides are also provided.

Many polynucleotide sequences, such as EST sequences, are publicly available and accessible through sequence databases. Some of these sequences are related to SEQ ID NO:183 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1391 of SEQ ID NO:183, b is an integer of 15 to 1405, where both a and b correspond to the positions of nucleotide residues shown in SEQ ID NO:183, and where the b is greater than or equal to a+14.

Features of Protein Encoded by Gene No: 174

The translation product of this gene shares sequence homology with testis enhanced gene transcript which is thought to be important in regulation of human development.

This gene is expressed primarily in infant brain and to a lesser extent in a variety of other tissues and cell types, including the prostate, testes, monocytes, macrophages, dendritic cells, keratinocytes, and adipocytes.

Therefore, polynucleotides and polypeptides of the invention are useful as reagents for differential identification of the tissue(s) or cell type(s) present in a biological sample and for diagnosis of diseases and conditions: neurological, developmental, immune and inflammation disorders. Similarly, polypeptides and antibodies directed to these polypeptides are useful in providing immunological probes for differential identification of the tissue(s) or cell type(s). For a number of disorders of the above tissues or cells, particularly of the brain and immune systems, expression of this gene at significantly higher or lower levels may be routinely detected in certain tissues and cell types (e.g., brain and other tissue of the nervous system, prostate, testes and other reproductive tissue, blood cells, keratinocytes, and adipocytes, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to testis enhanced gene transcript indicate that the protein product of this clone is useful for diagnosis and treatment of disorders involving the developing brain and the immune system.

This gene is believed to reside on chromosome 10. Nucleic acids related to this gene are useful therefore in linkage analysis as markers for chromosome 10.

Preferred epitopes include those comprising a sequence shown in SEQ ID NO.493 as residues: Ser-31 to Trp-37, Pro-41 to Thr-49, Arg-54 to Lys-63, Tyr-119 to His-125, Pro-181 to Lys-189, Gly-340 to Lys-345.

Many polynucleotide sequences, such as EST sequences, are publicly available and accessible through sequence databases. Some of these sequences are related to SEQ ID NO:184 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1582 of SEQ ID NO:184, b is an integer of 15 to 1596, where both a and b correspond to the positions of nucleotide residues shown in SEQ ID NO:184, and where the b is greater than or equal to a+14.

Features of Protein Encoded by Gene No: 175

This gene is expressed primarily in prostate and to a lesser extent in various other tissues, including placenta.

Therefore, polynucleotides and polypeptides of the invention are useful as reagents for differential identification of the tissue(s) or cell type(s) present in a biological sample and for diagnosis of diseases and conditions which include, but are not limited to, cancers, especially of the prostate. Similarly, polypeptides and antibodies directed to these polypeptides are useful in providing immunological probes for differential identification of the tissue(s) or cell type(s). For a number of disorders of the above tissues or cells, particularly of the prostate, expression of this gene at significantly higher or lower levels may be routinely detected in certain tissues and cell types (e.g., prostate and placenta, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that the protein product of this clone is useful for diagnosis and treatment of prostate disorders and cancer. It may also be useful for the diagnosis and treatment of endocrine disorders.

Preferred epitopes include those comprising a sequence shown in SEQ ID NO.494 as residues: Lys-10 to Trp-19, Arg-49 to Leu-54, Val-78 to Val-87, Pro-141 to Lys-148.

Many polynucleotide sequences, such as EST sequences, are publicly available and accessible through sequence databases. Some of these sequences are related to SEQ ID NO:185 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2279 of SEQ ID NO:185, b is an integer of 15 to 2293, where both a and b correspond to the positions of nucleotide residues shown in SEQ ID NO:185, and where the b is greater than or equal to a+14.

Features of Protein Encoded by Gene No: 176

The translation product of this gene shares sequence homology with Sacchromyces cerevisiae YNT20 gene which is thought to be important in mitochondrial function.

This gene is expressed at a particularly high level in muscle tissue.

Therefore, polynucleotides and polypeptides of the invention are useful as reagents for differential identification of the tissue(s) or cell type(s) present in a biological sample and for diagnosis of diseases related to such tissues and cell types including: muscle wasting diseases. Similarly, polypeptides and antibodies directed to these polypeptides are useful in providing immunological probes for differential identification of the tissue(s) or cell type(s). For a number of disorders of the above tissues or cells, particularly of the neuromuscular system, expression of this gene at significantly higher or lower levels may be routinely detected in certain tissues and cell types (e.g., muscle and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to the YNT20 gene indicate that this protein is useful for treatment and detection of neuromuscular diseases caused by loss of mitochondrial function. For example this gene or its protein product could be used in replacement therapy for such diseases.

Preferred epitopes include those comprising a sequence shown in SEQ ID NO.495 as residues: Arg-91 to Pro-96, Val-106 to Leu-113, Lys-180 to Lys-187, Asn-191 to Val-198.

Many polynucleotide sequences, such as EST sequences, are publicly available and accessible through sequence databases. Some of these sequences are related to SEQ ID NO:186 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1198 of SEQ ID NO:186, b is an integer of 15 to 1212, where both a and b correspond to the positions of nucleotide residues shown in SEQ ID NO:186, and where the b is greater than or equal to a+14.

Features of Protein Encoded by Gene No: 177

This gene is expressed primarily in the brain and to a lesser extent in kidney, placenta, smooth muscle, heart and lung.

Therefore, polynucleotides and polypeptides of the invention are useful as reagents for differential identification of the tissue(s) or cell type(s) present in a biological sample and for diagnosis of diseases and conditions: neuromuscular diseases, degenerative diseases of the central nervous system, and heart disease. Similarly, polypeptides and antibodies directed to these polypeptides are useful in providing immunological probes for differential identification of the tissue(s) or cell type(s). For a number of disorders of the above tissues or cells, particularly of the neuromuscular system, central nervous system, and heart, expression of this gene at significantly higher or lower levels may be routinely detected in certain tissues and cell types (e.g., brain and other tissue of the nervous system, kidney, placenta, muscle, heart and lung, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

This gene or its protein product could also be used for replacement therapy for the above mentioned diseases.

Preferred epitopes include those comprising a sequence shown in SEQ ID NO.496 as residues: Arg-12 to Glu-18, Asn-38 to Phe-47, Arg-56 to Val-62.

Many polynucleotide sequences, such as EST sequences, are publicly available and accessible through sequence databases. Some of these sequences are related to SEQ ID NO:187 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1591 of SEQ ID NO:187, b is an integer of 15 to 1605, where both a and b correspond to the positions of nucleotide residues shown in SEQ ID NO:187, and where the b is greater than or equal to a+14.

Features of Protein Encoded by Gene No: 178

The translation product of this gene shares sequence homology with caldesmon which is thought to be important in the cellular response to changes in glucose levels.

This gene is expressed primarily in multiple tissues including brain and retina.

Therefore, polynucleotides and polypeptides of the invention are useful as reagents for identification of the tissue(s) or cell type(s) present in a biological sample and for diagnosis of diseases and conditions: central nervous system disorders and retinopathy. Similarly, polypeptides and antibodies directed to these polypeptides are useful in providing immunological probes for identification of the tissue(s) or cell type(s). For a number of disorders of the above tissues or cells, particularly of the CNS disorders and retinopathy, expression of this gene at significantly higher or lower levels may be routinely detected in certain tissues and cell types (e.g., brain and other tissue of the nervous system, and retinal tissue, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to caldesmon indicate that polynucleotides and polypeptides corresponding to this gene are useful for treatment of retinopathies.

This gene is believe to be useful as a marker for chromosomes 1 and 3 in linkage analysis studies.

Preferred epitopes include those comprising a sequence shown in SEQ ID NO.497 as residues: Met-1 to Gly-7, Glu-17 to Glu-28, Lys-39 to Asp-45, Ser-50 to Ser-63, Glu-82 to Phe-88, Pro-97 to Lys-109, Gln-124 to Arg-129, Val-145 to Lys-157, Glu-163 to Leu-168, Ile-186 to Glu-195, Glu-198 to Arg-230, Asn-240 to Phe-252, Pro-256 to Glu-264.

Many polynucleotide sequences, such as EST sequences, are publicly available and accessible through sequence databases. Some of these sequences are related to SEQ ID NO:188 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1502 of SEQ ID NO:188, b is an integer of 15 to 1516, where both a and b correspond to the positions of nucleotide residues shown in SEQ ID NO:188, and where the b is greater than or equal to a+14.

Features of Protein Encoded by Gene No: 179

The translation product of this gene shares sequence homology with mouse fibrosin protein which is thought to be important in regulation of fibrinogenesis in certain chronic inflammatory diseases.

This gene is expressed primarily in amniotic cells and breast tissue.

Therefore, polynucleotides and polypeptides of the invention are useful as reagents for differential identification of the tissue(s) or cell type(s) present in a biological sample and for diagnosis of breast cancer and abnormal embryo development. Similarly, polypeptides and antibodies directed to these polypeptides are useful in providing immunological probes for differential identification of the tissue(s) or cell type(s). For a number of disorders of the above tissues or cells, particularly of the reproductive system, expression of this gene at significantly higher or lower levels may be routinely detected in certain tissues and cell types (e.g., amniotic cells, and mammary tissue, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to fibrosin indicate that the protein product of this clone is useful for treatment of breast cancer. This gene or its protein product could be used in replacement therapy for breast cancer. In addition the protein product of this gene is useful in the treatment of chronic inflammatory diseases.

This gene is believed to reside on chromosome 15. Polynucleotides related to this gene are believed to useful, therefore, in linkage analysis as markers for chromosome 15.

Many polynucleotide sequences, such as EST sequences, are publicly available and accessible through sequence databases. Some of these sequences are related to SEQ ID NO:189 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 667 of SEQ ID NO:189, b is an integer of 15 to 681, where both a and b correspond to the positions of nucleotide residues shown in SEQ ID NO:189, and where the b is greater than or equal to a+14.

Features of Protein Encoded by Gene No: 180

This gene is expressed in several infant tissues including brain and liver and various adult tissues including brain, lung, liver, testes, and prostate.

Therefore, polynucleotides and polypeptides of the invention are useful as reagents for differential identification of the tissue(s) or cell type(s) present in a biological sample and for diagnosis of diseases and conditions which include, but are not limited to, brain cancer, lung cancer, liver cancer and cancers of the reproductive system. Similarly, polypeptides and antibodies directed to these polypeptides are useful in providing immunological probes for differential identification of the tissue(s) or cell type(s). For a number of disorders of the above tissues or cells, particularly of the central nervous system, hepatic system, and reproductive system, expression of this gene at significantly higher or lower levels may be routinely detected in certain tissues and cell types (e.g., brain and other tissue of the nervous system, lung, liver, testes and other reproductive tissue, and prostate, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution of this gene product indicates that the protein product of this clone is involved in growth regulation and could be used as a growth factor or growth blocker in a variety of settings including treatment of cancers.

Preferred epitopes include those comprising a sequence shown in SEQ ID NO.499 as residues: Pro-153 to Arg-158.

Many polynucleotide sequences, such as EST sequences, are publicly available and accessible through sequence databases. Some of these sequences are related to SEQ ID NO:190 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1000 of SEQ ID NO:190, b is an integer of 15 to 1014, where both a and b correspond to the positions of nucleotide residues shown in SEQ ID NO:190, and where the b is greater than or equal to a+14.

Features of Protein Encoded by Gene No: 181

This gene is expressed primarily in activated monocytes and to a lesser extent in melanocytes and dendritic cells.

Therefore, polynucleotides and polypeptides of the invention are useful as reagents for differential identification of the tissue(s) or cell type(s) present in a biological sample and for diagnosis of immune system diseases and cancer. Similarly, polypeptides and antibodies directed to these polypeptides are useful in providing immunological probes for differential identification of the tissue(s) or cell type(s). For a number of disorders of the above tissues or cells, particularly of the immune system, expression of this gene at significantly higher or lower levels may be routinely detected in certain tissues and cell types (e.g., blood cells, melanocytes, and dendritic cells, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution indicates that the protein product of this clone could be involved in growth regulation and could be used as a growth factor or growth blocker in a variety of settings including treatment of cancers.

Preferred epitopes include those comprising a sequence shown in SEQ ID NO.500 as residues: Asp-35 to Asp-41, Ser-72 to Glu-77, Lys-l 10 to His-l 15, Pro-160 to Gln-165.

Many polynucleotide sequences, such as EST sequences, are publicly available and accessible through sequence databases. Some of these sequences are related to SEQ ID NO:191 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2765 of SEQ ID NO:191, b is an integer of 15 to 2779, where both a and b correspond to the positions of nucleotide residues shown in SEQ ID NO:191, and where the b is greater than or equal to a+14.

Features of Protein Encoded by Gene No: 182

This gene is expressed primarily in placenta and several tumors of various tissue origin and to a lesser extent in normal tissues including liver, lung, brain, and skin, Therefore, polynucleotides and polypeptides of the invention are useful as reagents for differential identification of the tissue(s) or cell type(s) present in a biological sample and for diagnosis of cancers of all kinds. Similarly, polypeptides and antibodies directed to these polypeptides are useful in providing immunological probes for differential identification of the tissue(s) or cell type(s). For a number of disorders of the above tissues or cells, particularly of the central nervous system, respiratory system and skin, expression of this gene at significantly higher or lower levels may be routinely detected in certain tissues and cell types (e.g., liver, lung, brain and other tissues of the nervous system, and skin, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The high expression of this gene in multiple tumors indicates that the protein product of the clone may be involved in cell growth control and therefore would be useful for treatment of certain cancers. Likewise molecules developed to block the activity of the protein product of this clone could be used to block its potential role in tumor growth promotion.

This gene is believe to reside on chromosome 6. Polynucleotides related to this gene are believed, therefore, to be useful in linkage analysis for chromosome 6.

Preferred epitopes include those comprising a sequence shown in SEQ ID NO.501 as residues: Gln-37 to Gln-43, Cys-51 to Cys-65.

Many polynucleotide sequences, such as EST sequences, are publicly available and accessible through sequence databases. Some of these sequences are related to SEQ ID NO:192 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1909 of SEQ ID NO:192, b is an integer of 15 to 1923, where both a and b correspond to the positions of nucleotide residues shown in SEQ ID NO:192, and where the b is greater than or equal to a+14.

Features of Protein Encoded by Gene No: 183

The translation product of this gene shares sequence homology with the mouse Ndrl gene which is thought to be important in cancer progression and atherogenesis (see J Biol Chem. 1996 Nov 22; 271(47): 29659–29665), incorporated herein by reference in its entirety.

This gene is expressed in multiple cell types and tissues including brain, lung, kidney, bone marrow, liver, and spleen.

Therefore, polynucleotides and polypeptides of the invention are useful as reagents for differential identification of the tissue(s) or cell type(s) present in a biological sample and for diagnosis of all types of cancers. Similarly, polypeptides and antibodies directed to these polypeptides are useful in providing immunological probes for differential identification of the tissue(s) or cell type(s). For a number of disorders of the above tissues or cells, particularly of the nervous, immune, and endocrine systems, expression of this gene at significantly higher or lower levels may be routinely detected in certain tissues and cell types (e.g., brain and other tissue of the nervous system, lung, kidney, bone marrow, liver and spleen, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The tissue distribution and homology to Ndr1 gene, which is thought to be involved in cancer progression, indicate that polynucleotides and polypeptides corresponding to this gene are useful for treatment of certain cancers. Likewise molecules developed to block the activity of the protein product of this clone could be used to block its potential role in tumor growth promotion.

This gene is believed to reside on chromosome 8. Polynucleotides derived from this gene are useful, therefore, in linkage analysis as markers for chromosome 8.

Many polynucleotide sequences, such as EST sequences, are publicly available and accessible through sequence databases. Some of these sequences are related to SEQ ID NO:193 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 2332 of SEQ ID NO:193, b is an integer of 15 to 2346, where both a and b correspond to the positions of nucleotide residues shown in SEQ ID NO:193, and where the b is greater than or equal to a+14.

Features of Protein Encoded by Gene No: 184

This gene is expressed primarily in early stage human brain and liver and to a lesser extent in several other fetal tissues.

Therefore, polynucleotides and polypeptides of the invention are useful as reagents for differential identification of the tissue(s) or cell type(s) present in a biological sample and for diagnosis of diseases and conditions: brain and liver cancers. Similarly, polypeptides and antibodies directed to these polypeptides are useful in providing immunological probes for differential identification of the tissue(s) or cell type(s). For a number of disorders of the above tissues or cells, particularly of the central nervous system and immune system, expression of this gene at significantly higher or lower levels may be routinely detected in certain tissues and cell types (e.g., brain and other tissue of the nervous system, liver, and fetal tissue, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The expression of this gene in embryonic tissues indicates that the protein could be involved in growth regulation and could be used as a growth factor or growth blocker in a variety of settings including treatment of cancers.

This gene is believed to reside on chromosome 11. Polynucleotides derived from this gene are useful, therefore, in linkage analysis as markers for chromosome 11.

Preferred epitopes include those comprising a sequence shown in SEQ ID NO.503 as residues: Pro-116 to Ser-127, Pro-136 to Tyr-146.

Many polynucleotide sequences, such as EST sequences, are publicly available and accessible through sequence databases. Some of these sequences are related to SEQ ID NO:194 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 3040 of SEQ ID NO:194, b is an integer of 15 to 3054, where both a and b correspond to the positions of nucleotide residues shown in SEQ ID NO:194, and where the b is greater than or equal to a+14.

Features of Protein Encoded by Gene No: 185

This gene is expressed primarily in infant and embryonic brain.

Therefore, polynucleotides and polypeptides of the invention are useful as reagents for differential identification of the tissue(s) or cell type(s) present in a biological sample and for diagnosis of degenerative nervous system disorders and brain cancer. Similarly, polypeptides and antibodies directed to these polypeptides are useful in providing immunological probes for differential identification of the tissue(s) or cell type(s). For a number of disorders of the above tissues or cells, particularly of the central nervous system, expression of this gene at significantly higher or lower levels may be routinely detected in certain tissues and cell types (e.g., embryonic tissue, brain and other tissue of the nervous system, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The expression of this gene in embryonic tissues indicates that the protein could be involved in growth regulation and could be used as a growth factor or growth blocker in a variety of settings including treatment of cancers.

Many polynucleotide sequences, such as EST sequences, are publicly available and accessible through sequence databases. Some of these sequences are related to SEQ ID NO:195 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 893 of SEQ ID NO:195, b is an integer of 15 to 907, where both a and b correspond to the positions of nucleotide residues shown in SEQ ID NO:195, and where the b is greater than or equal to a+14.

Features of Protein Encoded by Gene No: 186

This gene is expressed primarily in multiple tissues including placenta, fetal lung, fetal liver, and brain.

Therefore, polynucleotides and polypeptides of the invention are useful as reagents for differential identification of the tissue(s) or cell type(s) present in a biological sample and for diagnosis of all types of cancers including liver, brain and lung. Similarly, polypeptides and antibodies directed to these polypeptides are useful in providing immunological probes for differential identification of the tissue(s) or cell type(s). For a number of disorders of the above tissues or cells, particularly of the central nervous system, pulmonary system, and hepatic system, expression of this gene at significantly higher or lower levels may be routinely detected in certain tissues and cell types (e.g., placenta, lung, liver, and brain and other tissue of the nervous system, and cancerous and wounded tissues) or bodily fluids (e.g., serum, plasma, urine, synovial fluid or spinal fluid) or another tissue or cell sample taken from an individual having such a disorder, relative to the standard gene expression level, i.e., the expression level in healthy tissue or bodily fluid from an individual not having the disorder.

The expression of this gene in embryonic tissues indicates that the protein could be involved in growth regulation and could be used as a growth factor or growth blocker in a variety of settings including treatment of cancers.

This gene is believed to reside on chromosome 10. Polynucleotides derived from this gene are useful, therefore, in linkage analysis as markers for chromosome 10.

Preferred epitopes include those comprising a sequence shown in SEQ ID NO.505 as residues: Pro-10 to Glu-17, Gly-42 to Gln-51.

Many polynucleotide sequences, such as EST sequences, are publicly available and accessible through sequence databases. Some of these sequences are related to SEQ ID NO:196 and may have been publicly available prior to conception of the present invention. Preferably, such related polynucleotides are specifically excluded from the scope of the present invention. To list every related sequence would be cumbersome. Accordingly, preferably excluded from the present invention are one or more polynucleotides comprising a nucleotide sequence described by the general formula of a-b, where a is any integer between 1 to 1276 of SEQ ID NO:196, b is an integer of 15 to 1290, where both a and b correspond to the positions of nucleotide residues shown in SEQ ID NO:196, and where the b is greater than or equal to a+14.

TABLE 1

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of first AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 1 | HTTEZ21 | 97897 02/26/97 209043 05/15/97 | Uni-ZAP XR | 1 | 1019 | 262 | 859 | 177 | 177 | 320 | 1 | 17 | 18 | 22 |
| 1 | HTTEZ21 | 97897 02/26/97 209043 05/15/97 | Uni-ZAP XR | 197 | 582 | 1 | 582 | 177 | 177 | 506 | 1 | 17 | 18 | 22 |
| 1 | HTTEZ21 | 97897 02/26/97 209043 05/15/97 | Uni-ZAP XR | 198 | 1020 | 296 | 830 | 442 | 442 | 507 | 1 | 18 | 19 | 22 |
| 2 | HBGBW52 | 97897 02/26/97 209043 05/15/97 | Uni-ZAP XR | 12 | 465 | 1 | 465 | 81 | 81 | 321 | 1 | 30 | 31 | 128 |
| 2 | HBGBW52 | 97897 02/26/97 209043 05/15/97 | Uni-ZAP XR | 199 | 524 | 229 | 343 |  | 196 | 508 | 1 | 20 | 21 | 33 |
| 3 | HCUFM41 | 97897 02/26/97 209043 05/15/97 | ZAP Express | 13 | 474 | 1 | 474 | 1 | 1 | 322 | 1 | 24 | 25 | 28 |
| 3 | HCUFM41 | 97897 02/26/97 209043 05/15/97 | ZAP Express | 200 | 332 | 1 | 319 | 35 | 35 | 509 | 1 | 24 | 25 | 28 |
| 4 | HCUFQ22 | 97897 02/26/97 209043 05/15/97 | ZAP Express | 14 | 314 | 1 | 298 | 122 | 122 | 323 | 1 | 34 | 35 | 64 |
| 5 | HCUFV01 | 97897 02/26/97 209043 05/15/97 | ZAP Express | 15 | 613 | 1 | 613 | 30 | 30 | 324 | 1 | 18 | 19 | 21 |
| 6 | HCUGA50 | 97897 02/26/97 209043 05/15/97 | ZAP Express | 16 | 356 | 1 | 356 | 239 | 239 | 325 | 1 | 22 | 23 | 39 |
| 7 | HCUIM14 | 97897 02/26/97 209043 05/15/97 | ZAP Express | 17 | 414 | 185 | 414 | 278 | 278 | 326 | 1 | 26 | 27 | 33 |
| 8 | HLDOU93 | 97897 02/26/97 209043 05/15/97 | pCMVSport 3.0 | 18 | 469 | 1 | 469 | 77 | 77 | 327 | 1 | 44 | 45 | 88 |
| 9 | HEIAX07 | 97897 02/26/97 209043 05/15/97 | Uni-ZAP XR | 19 | 550 | 1 | 550 | 129 | 129 | 328 | 1 |  |  | 23 |
| 9 | HEIAX07 | 97897 02/26/97 209043 05/15/97 | Uni-ZAP XR | 201 | 376 | 9 | 376 |  | 1 | 510 | 1 | 8 | 9 | 15 |
| 10 | HSAXR76 | 97897 02/26/97 209043 05/15/97 | Uni-ZAP XR | 20 | 773 | 10 | 773 | 176 | 176 | 329 | 1 |  |  | 27 |
| 10 | HSAXR76 | 97897 02/26/97 209043 05/15/97 | Uni-ZAP XR | 202 | 741 | 55 | 741 | 190 | 190 | 511 | 1 |  |  | 27 |
| 11 | HNGJJ68 | 97897 02/26/97 209043 05/15/97 | Uni-ZAP XR | 21 | 991 | 1 | 991 | 62 | 62 | 330 | 1 | 30 | 31 | 63 |
| 11 | HNGJJ68 | 97897 02/26/97 209043 05/15/97 | Uni-ZAP XR | 203 | 1192 | 253 | 1137 |  | 409 | 512 | 1 |  |  | 19 |

TABLE 1-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of first AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 12 | HCFAW04 | 97897 02/26/97 209043 05/15/97 | pSport1 | 22 | 653 | 1 | 653 | 64 | 64 | 331 | 1 | 30 | 31 | 196 |
| 12 | HCFAW04 | 97897 02/26/97 209043 05/15/97 | pSport1 | 204 | 589 | 1 | 513 | 109 | 109 | 513 | 1 | | | 29 |
| 13 | HLMAV65 | 97897 02/26/97 209043 05/15/97 | Uni-ZAP XR | 23 | 1486 | 596 | 1418 | 102 | 102 | 332 | 1 | 54 | 55 | 251 |
| 13 | HLMAV65 | 97897 02/26/97 209043 05/15/97 | Uni-ZAP XR | 205 | 847 | 1 | 839 | 87 | 87 | 514 | 1 | 30 | 31 | 74 |
| 13 | HLMAV65 | 97897 02/26/97 209043 05/15/97 | Uni-ZAP XR | 206 | 852 | 75 | 850 | | 690 | 515 | 1 | | | 10 |
| 13 | HTXEF04 | 209235 09/04/97 | Uni-ZAP XR | 207 | 1354 | 54 | 1354 | 100 | 100 | 516 | 1 | 33 | 34 | 206 |
| 14 | HPMFD84 | 97897 02/26/97 209043 05/15/97 | Uni-ZAP XR | 24 | 2323 | 1017 | 2059 | 1242 | 1242 | 333 | 1 | 21 | 22 | 67 |
| 14 | HPMFD84 | 97897 02/26/97 209043 05/15/97 | Uni-ZAP XR | 208 | 1378 | 113 | 1226 | 303 | 303 | 517 | 1 | 25 | 26 | 36 |
| 15 | HE6DB26 | 97897 02/26/97 209043 05/15/97 | Uni-ZAP XR | 25 | 683 | 1 | 683 | 304 | 304 | 334 | 1 | 30 | 31 | 8 |
| 15 | HE6DB26 | 97897 02/26/97 209043 05/15/97 | Uni-ZAP XR | 209 | 1166 | 281 | 884 | 567 | 567 | 518 | 1 | 18 | 19 | 19 |
| 16 | HHFFL33 | 97897 02/26/97 209043 05/15/97 | Uni-ZAP XR | 26 | 2036 | 14 | 1959 | 214 | 214 | 335 | 1 | 20 | 21 | 36 |
| 17 | HODBD33 | 97897 02/26/97 209043 05/15/97 | Uni-ZAP XR | 27 | 717 | 1 | 717 | 70 | 70 | 336 | 1 | 30 | 31 | 62 |
| 17 | HODBD33 | 97897 02/26/97 209043 05/15/97 | Uni-ZAP XR | 210 | 697 | 2 | 697 | 33 | 33 | 519 | 1 | 31 | 32 | 32 |
| 18 | HMDAE90 | 97897 02/26/97 209043 05/15/97 | Uni-ZAP XR | 28 | 495 | 1 | 495 | 39 | 39 | 337 | 1 | 24 | 25 | 35 |
| 19 | HOUAW01 | 97897 02/26/97 209043 05/15/97 | Uni-ZAP XR | 29 | 556 | 1 | 556 | 116 | 116 | 338 | 1 | 19 | 20 | 23 |
| 20 | HBJAE44 | 97897 02/26/97 209043 05/15/97 | Uni-ZAP XR | 30 | 434 | 1 | 434 | 78 | 78 | 339 | 1 | 35 | 36 | 40 |
| 21 | HCFME41 | 97897 02/26/97 209043 05/15/97 | pSport1 | 31 | 715 | 1 | 715 | 87 | 87 | 340 | 1 | 30 | 31 | 110 |
| 21 | HCFME41 | 97897 02/26/97 209043 05/15/97 | pSport1 | 211 | 932 | 274 | 932 | 387 | 387 | 520 | 1 | 27 | 28 | 28 |
| 22 | HOGCO71 | 97897 02/26/97 | pCMVSport 2.0 | 32 | 486 | 1 | 486 | 137 | 137 | 341 | 1 | 21 | 22 | 106 |

TABLE 1-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of first AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 23 | HOSEX08 | 97897 05/15/97 02/26/97 209043 | Uni-ZAP XR | 33 | 725 | 1 | 725 | 436 | 436 | 342 | 1 | 30 | 31 | 49 |
| 23 | HOSEX08 | 97897 05/15/97 02/26/97 209043 | Uni-ZAP XR | 212 | 661 | 1 | 647 | 81 | 81 | 521 | 1 | 25 | 26 | 26 |
| 24 | HSKNJ72 | 97897 05/15/97 02/26/97 209043 | pBluescript | 34 | 437 | 1 | 437 | 85 | 85 | 343 | 1 | 30 | 31 | 48 |
| 25 | HEBEB69 | 97898 05/15/97 02/26/97 209044 | Uni-ZAP XR | 35 | 943 | 1 | 943 | 196 | 196 | 344 | 1 | 30 | 31 | 40 |
| 25 | HEBEB69 | 97898 05/15/97 02/26/97 209044 | Uni-ZAP XR | 213 | 592 | 1 | 534 | 72 | 72 | 522 | 1 | 24 | 25 | 33 |
| 26 | HE6EH18 | 97898 05/15/97 02/26/97 209044 | Uni-ZAP XR | 36 | 604 | 1 | 604 | 375 | 375 | 345 | 1 | 20 | 21 | 76 |
| 26 | HE6EH18 | 97898 05/15/97 02/26/97 209044 | Uni-ZAP XR | 214 | 938 | 1 | 509 |  | 17 | 523 | 1 | 30 | 31 | 47 |
| 27 | HSAUZ47 | 97898 05/15/97 02/26/97 209044 | Uni-ZAP XR | 37 | 349 | 1 | 349 | 10I | 101 | 346 | 1 | 27 | 28 | 83 |
| 28 | HSSDM73 | 97898 05/15/97 02/26/97 209044 | Uni-ZAP XR | 38 | 672 | 1 | 672 | 22 | 22 | 347 | 1 | 38 | 39 | 42 |
| 29 | HBMVK68 | 97898 05/15/97 02/26/97 209044 | Uni-ZAP XR | 39 | 1908 | 135 | 1908 | 309 | 309 | 348 | 1 | 20 | 21 | 26 |
| 30 | HMKDC66 | 97898 05/15/97 02/26/97 209044 | pSport1 | 40 | 458 | 93 | 458 | 147 | 147 | 349 | 1 | 24 | 25 | 26 |
| 31 | HMKCU94 | 97898 05/15/97 02/26/97 209044 | pSport1 | 41 | 1153 | 500 | 1153 | 427 | 427 | 350 | 1 | 30 | 31 | 156 |
| 31 | HMKCU94 | 97898 05/15/97 02/26/97 209044 | pSport1 | 215 | 1079 | 502 | 896 |  | 739 | 524 | 1 | 23 | 24 | 43 |
| 32 | HRDEW41 | 97898 05/15/97 02/26/97 209044 | Uni-ZAP XR | 42 | 1983 | 1092 | 1983 | 27 | 27 | 351 | 1 | 11 | 12 | 519 |
| 32 | HRDEW41 | 97898 05/15/97 02/26/97 209044 | Uni-ZAP XR | 216 | 3791 | 2757 | 3357 |  | 2030 | 525 | 1 |  |  | 3 |
| 33 | HTOJN06 | 97898 05/15/97 02/26/97 209044 | Uni-ZAP XR | 43 | 1406 | 1 | 695 |  | 19 | 352 | 1 | 19 | 20 | 39 |
| 34 | HBGDA21 | 97898 05/15/97 02/26/97 209044 | Uni-ZAP XR | 44 | 1391 | 851 | 1153 | 74 | 74 | 353 | 1 | 30 | 31 | 233 |
| 34 | RBGDA21 | 97898 05/15/97 02/26/97 209044 | Uni-ZAP XR | 217 | 1334 | 822 | 1036 |  | 638 | 526 | 1 | 18 | 19 | 174 |

TABLE 1-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of first AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 35 | HFGAK75 | 209044 05/15/97 97898 02/26/97 | Uni-ZAP XR | 45 | 1569 | 768 | 1569 | 14 | 14 | 354 | 1 | 19 | 20 | 168 |
| 35 | HFGAK75 | 209044 05/15/97 97898 02/26/97 | Uni-ZAP XR | 218 | 1511 | 770 | 1404 | 844 | 844 | 527 | 1 | 32 | 33 | 43 |
| 36 | HHPBD40 | 209044 05/15/97 97898 02/26/97 | Uni-ZAP XR | 46 | 1924 | 1 | 1681 | 62 | 62 | 355 | 1 | 19 | 20 | 43 |
| 37 | HOVCL83 | 209044 05/15/97 97898 02/26/97 | pSport1 | 47 | 475 | 252 | 396 | 141 | 141 | 356 | 1 | 37 | 38 | 78 |
| 38 | HBCAY62 | 209044 05/15/97 97898 02/26/97 | Uni-ZAP XR | 48 | 346 | 1 | 346 | 61 | 61 | 357 | 1 | 19 | 20 | 24 |
| 39 | HBICM48 | 209044 05/15/97 97898 02/26/97 | Uni-ZAP XR | 49 | 1366 | 882 | 1300 | 177 | 177 | 358 | 1 | 30 | 31 | 273 |
| 39 | HBICM48 | 209044 05/15/97 97898 02/26/97 | Uni-ZAP XR | 219 | 642 | 192 | 581 | | 448 | 528 | 1 | | | 13 |
| 40 | HLTCL35 | 209044 05/15/97 97898 02/26/97 | Uni-ZAP XR | 50 | 1405 | 110 | 1404 | 61 | 61 | 359 | 1 | 30 | 31 | 46 |
| 40 | HLTCL35 | 209044 05/15/97 97898 02/26/97 | Uni-ZAP XR | 220 | 1241 | 1 | 1241 | 172 | 172 | 529 | 1 | 21 | 22 | 30 |
| 41 | HLHCK50 | 209044 05/15/97 97898 02/26/97 | Uni-ZAP XR | 51 | 2633 | 29 | 310 | 2064 | 2064 | 360 | 1 | 18 | 19 | 117 |
| 41 | HLHCK50 | 209044 05/15/97 97898 02/26/97 | Uni-ZAP XR | 221 | 504 | 207 | 485 | 222 | 222 | 530 | 1 | | | 3 |
| 42 | HRSAN45 | 209044 05/15/97 97899 02/26/97 | ZAP Express | 52 | 777 | 1 | 214 | 113 | 113 | 361 | 1 | 24 | 25 | 52 |
| 43 | HSNBB14 | 209045 05/15/97 97899 02/26/97 | Uni-ZAP XR | 53 | 602 | 1 | 419 | 41 | 41 | 362 | 1 | 59 | 60 | 131 |
| 43 | HSNBB14 | 209045 05/15/97 97899 02/26/97 | Uni-ZAP XR | 222 | 1080 | 186 | 6116 | 399 | 399 | 531 | 1 | 26 | 27 | 47 |
| 44 | HMABL38 | 209045 05/15/97 97899 02/26/97 | Uni-ZAP XR | 54 | 1749 | 222 | 1749 | 166 | 166 | 363 | 1 | 30 | 31 | 203 |
| 44 | HMABL38 | 209045 05/15/97 97899 02/26/97 | Uni-ZAP XR | 223 | 1258 | 149 | 1190 | 254 | 254 | 532 | 1 | 18 | 19 | 26 |
| 45 | HSKDK47 | 209045 05/15/97 97899 02/26/97 | Uni-ZAP XR | 55 | 1896 | 596 | 1614 | 650 | 650 | 364 | 1 | 33 | 34 | 47 |
| 46 | HOSFH03 | 209045 05/15/97 97899 02/26/97 | Uni-ZAP XR | 56 | 1753 | 555 | 1753 | 414 | 414 | 365 | 1 | 18 | 19 | 72 |

TABLE 1-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of first AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 46 | HOSFH03 | 209045 05/15/97 97899 02/26/97 | Uni-ZAP XR | 224 | 1693 | 554 | 1693 | | 526 | 533 | 1 | 25 | 26 | 58 |
| 47 | HOGAV75 | 209045 05/15/97 97899 02/26/97 | pCMVSport 2.0 | 57 | 1220 | 690 | 1024 | 128 | 128 | 366 | 1 | 30 | 31 | 101 |
| 47 | HGGAV75 | 209045 05/15/97 97899 02/26/97 | pCMVSport 2.0 | 225 | 1196 | 712 | 1163 | | 1097 | 534 | 1 | | | 19 |
| 48 | HFCAI74 | 209045 05/15/97 97899 02/26/97 | Uni-ZAP XR | 58 | 1049 | 362 | 1049 | 335 | 335 | 367 | 1 | 33 | 34 | 48 |
| 49 | HAGBI17 | 209045 05/15/97 97899 02/26/97 | Uni-ZAP XR | 59 | 1776 | 854 | 1737 | 189 | 189 | 368 | 1 | 30 | 31 | 178 |
| 49 | HAGBI17 | 209045 05/15/97 97899 02/26/97 | Uni-ZAP XR | 226 | 1791 | 979 | 1791 | 1164 | 1164 | 535 | 1 | 18 | 19 | 40 |
| 50 | HLFBC91 | 209045 05/15/97 97899 02/26/97 | pBluescript SK- | 60 | 443 | 1 | 443 | 164 | 164 | 369 | 1 | 21 | 22 | 25 |
| 51 | HPRCA31 | 209045 05/15/97 97899 02/26/97 | Uni-ZAP XR | 61 | 2888 | 1909 | 2888 | 90 | 90 | 370 | 1 | 30 | 31 | 223 |
| 51 | HPRCA31 | 209045 05/15/97 97899 02/26/97 | Uni-ZAP XR | 227 | 2517 | 1597 | 2517 | 1953 | 1953 | 536 | 1 | 18 | 19 | 57 |
| 52 | HPRCE95 | 209045 05/15/97 97899 02/26/97 | Uni-ZAP XR | 62 | 1851 | 1568 | 1736 | 139 | 139 | 371 | 1 | 30 | 31 | 348 |
| 52 | HPRCE95 | 209045 05/15/97 97899 02/26/97 | Uni-ZAP XR | 228 | 2424 | 299 | 2309 | | 530 | 537 | 1 | 17 | 18 | 21 |
| 53 | HHTLC66 | 209045 05/15/97 97899 02/26/97 | ZAP Express | 63 | 3542 | 883 | 3492 | 964 | 964 | 372 | 1 | 25 | 26 | 467 |
| 54 | HMADJ02 | 209045 05/15/97 97899 02/26/97 | Uni-ZAP XR | 64 | 883 | 237 | 883 | 229 | 229 | 373 | 1 | 30 | 31 | 151 |
| 54 | HMADJ02 | 209045 05/15/97 97899 02/26/97 | Uni-ZAP XR | 229 | 1080 | 242 | 1033 | 436 | 436 | 538 | 1 | 24 | 25 | 39 |
| 55 | HPRCU93 | 209045 05/15/97 97899 02/26/97 | Uni-ZAP XR | 65 | 1541 | 1 | 1541 | 236 | 236 | 374 | 1 | 30 | 31 | 372 |
| 55 | HPRCU93 | 209045 05/15/97 97899 02/26/97 | Uni-ZAP XR | 230 | 1336 | 4 | 1336 | 946 | 946 | 539 | 1 | 25 | 26 | 128 |
| 56 | HSAXS65 | 209045 05/15/97 97899 02/26/97 | Uni-ZAP XR | 66 | 732 | 41 | 698 | 163 | 163 | 375 | 1 | 18 | 19 | 82 |
| 56 | HSAXS65 | 209045 05/15/97 97899 02/26/97 | Uni-ZAP XR | 231 | 2043 | 1133 | 1756 | 1262 | 1262 | 540 | 1 | 20 | 21 | 82 |

TABLE 1-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of first AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 57 | HKTAG35 | 209045 05/15/97 209011 04/28/97 | Uni-ZAP XR | 67 | 631 | 1 | 631 | 34 | 34 | 376 | 1 | 30 | 31 | 97 |
| 57 | HKTAG35 | 97899 02/26/97 | Uni-ZAP XR | 232 | 629 | 1 | 629 | 264 | 264 | 541 | 1 | | | 20 |
| 57 | HMEFX42 | 209045 05/15/97 97899 02/26/97 | Lambda ZAP II | 233 | 540 | 25 | 536 | 227 | 227 | 542 | 1 | | | 20 |
| 58 | HHFHN61 | 209045 05/15/97 97899 02/26/97 | Uni-ZAP XR | 68 | 1751 | 375 | 1751 | 95 | 95 | 377 | 1 | 19 | 20 | 227 |
| 59 | HCWEF90 | 209045 05/15/97 97899 02/26/97 | ZAP Express | 69 | 508 | 1 | 508 | 22 | 22 | 378 | 1 | 30 | 31 | 78 |
| 59 | HCWEF90 | 209045 05/15/97 97899 02/26/97 | ZAP Express | 234 | 448 | 9 | 448 | | 1 | 543 | 1 | 22 | 23 | 75 |
| 60 | HHGCM20 | 209045 05/15/97 97899 02/26/97 | Lambda ZAP II | 70 | 245 | 1 | 245 | 93 | 93 | 379 | 1 | 28 | 29 | 50 |
| 61 | HFRAU10 | 209045 05/15/97 97900 02/26/97 | Uni-ZAP XR | 71 | 361 | 1 | 361 | 1 | 1 | 380 | 1 | 30 | 31 | 60 |
| 61 | HFRAU10 | 209046 05/15/97 97900 02/26/97 | Uni-ZAP XR | 235 | 407 | 1 | 407 | 210 | 210 | 544 | 1 | 17 | 18 | 60 |
| 62 | HATDT67 | 209046 05/15/97 97900 02/26/97 | Uni-ZAP XR | 72 | 713 | 8 | 713 | 169 | 169 | 381 | 1 | 30 | 31 | 39 |
| 62 | HATDT67 | 209046 05/15/97 97900 02/26/97 | Uni-ZAP XR | 236 | 830 | 190 | 580 | 329 | 329 | 545 | 1 | 28 | 29 | 39 |
| 63 | HOUBG93 | 209046 05/15/97 97900 02/26/97 | Uni-ZAP XR | 73 | 862 | 1 | 862 | 67 | 67 | 382 | 1 | 30 | 31 | 43 |
| 63 | HOUBG93 | 209046 05/15/97 97900 02/26/97 | Uni-ZAP XR | 237 | 932 | 138 | 905 | 287 | 287 | 546 | 1 | | | 2 |
| 64 | HMWEX24 | 209046 05/15/97 97900 02/26/97 | Uni-Zap XR | 74 | 4602 | 4162 | 4525 | 730 | 730 | 383 | 1 | 30 | 31 | 202 |
| 64 | HMWEX24 | 209046 05/15/97 97900 02/26/97 | Uni-Zap XR | 238 | 2786 | 2406 | 2739 | 2577 | 2577 | 547 | 1 | 22 | 23 | 36 |
| 65 | HSGBA84 | 209046 05/15/97 97900 02/26/97 | Uni-ZAP XR | 75 | 1255 | 1 | 1195 | 112 | 112 | 384 | 1 | 28 | 29 | 29 |
| 66 | HTDCD52 | 209046 05/15/97 97900 02/26/97 | Uni-ZAP XR | 76 | 475 | 1 | 475 | 13 | 13 | 385 | 1 | 30 | 31 | 135 |
| 66 | HTOCD52 | 209046 05/15/97 97900 02/26/97 209046 05/15/97 | Uni-ZAP XR | 239 | 458 | 1 | 458 | 26 | 26 | 548 | 1 | | | 14 |

TABLE 1-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of first AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 67 | HTGCP16 | 97900 02/26/97 209046 05/15/97 | Uni-ZAP XR | 77 | 465 | 25 | 299 | 74 | 74 | 386 | 1 | 33 | 34 | 41 |
| 68 | HKIXR69 | 97900 02/26197 209046 05/15/97 | pBluescript | 78 | 1907 | 1627 | 1730 | 26 | 26 | 387 | 1 | 30 | 31 | 467 |
| 68 | HKIXR69 | 97900 02/26/97 209046 05/15/97 | pBluescript | 240 | 591 | 1 | 444 | 251 | 251 | 549 | 1 | | | 18 |
| 69 | HETGJ09 | 97900 02/26/97 209046 05/15/97 | Uni-ZAP XR | 79 | 1168 | 136 | 1168 | 267 | 267 | 388 | 1 | 20 | 21 | 29 |
| 70 | HOBNC61 | 97900 02/26/97 209046 05/15/97 | Uni-ZAP XR | 80 | 1285 | 132 | 1285 | 292 | 292 | 389 | 1 | 27 | 28 | 29 |
| 71 | HFFAH94 | 97900 02/26/97 209046 05/15/97 | Lambda ZAP II | 81 | 1290 | 768 | 1054 | 701 | 701 | 390 | 1 | 21 | 22 | 138 |
| 72 | HB1A195 | 97900 02/26/97 209046 05/15/97 | Uni-ZAP XR | 82 | 684 | 1 | 684 | 119 | 119 | 391 | 1 | 30 | 31 | 74 |
| 73 | HSQEL25 | 97900 02/26/97 209046 05/15/97 | Uni-ZAP XR | 83 | 2024 | 1609 | 1953 | 200 | 200 | 392 | 1 | 30 | 31 | 520 |
| 73 | HSQEL25 | 97900 02/26/97 209046 05/15/97 | Uni-ZAP XR | 241 | 2449 | 1511 | 2378 | 488 | 488 | 550 | 1 | 30 | 31 | 269 |
| 73 | HSQEL25 | 97900 02/26/97 209046 05/15/97 | Uni-ZAP XR | 242 | 1286 | 391 | 959 | | 1204 | 551 | 1 | 9 | 10 | 10 |
| 74 | HEBEG68 | 97900 02/26/97 209046 05/15/97 | Uni-ZAP XR | 84 | 931 | 14 | 537 | 85 | 85 | 393 | 1 | 25 | 26 | 137 |
| 75 | HBIAB39 | 97900 02/26/97 209046 05/15/97 | Uni-ZAP XR | 85 | 825 | 59 | 802 | 66 | 66 | 394 | 1 | 30 | 31 | 185 |
| 75 | HBIAB39 | 97900 02/26/97 209046 05/15/97 | Uni-ZAP XR | 243 | 734 | 1 | 734 | 1 | 1 | 552 | 1 | 37 | 38 | 107 |
| 75 | HBIAB39 | 97900 02/26/97 209046 05/15/97 | Uni-ZAP XR | 244 | 809 | 80 | 794 | | 294 | 553 | 1 | 15 | 16 | 106 |
| 76 | HTXDU73 | 97900 02/26/97 209046 05/15/97 | Uni-ZAP XR | 86 | 1238 | 36 | 918 | 17 | 17 | 395 | 1 | | | 1 |
| 77 | HOEAS24 | 97900 02/26/97 209046 05/15/97 | Uni-ZAP XR | 87 | 1460 | 9 | 1458 | 166 | 166 | 396 | 1 | 53 | 54 | 298 |
| 77 | HOEAS24 | 97900 02/26/97 209046 05/15/97 | Uni-ZAP XR | 245 | 2201 | 841 | 2080 | 507 | 507 | 554 | 1 | 43 | 44 | 135 |
| 77 | HOEAS24 | 97900 02/26/97 209046 05/15/97 | Uni-ZAP XR | 246 | 1661 | 311 | 1520 | 390 | 390 | 555 | 1 | 35 | 36 | 424 |

TABLE 1-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of first AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 78 | HTEIY30 | 97900 02/26/97 209046 05/15/97 | Uni-ZAP XR | 88 | 1395 | 567 | 1395 | 639 | 639 | 397 | 1 | 36 | 37 | 49 |
| 79 | HSKNE46 | 97900 02/26/97 209046 05/15/97 | pBluescript | 89 | 1186 | 352 | 1186 | 540 | 540 | 398 | 1 | 49 | 50 | 60 |
| 79 | HSKNE46 | 97900 02/26/97 209046 05/15/97 | pBluescript | 247 | 1146 | 329 | 1146 | 564 | 564 | 556 | 1 | 21 | 22 | 39 |
| 80 | HPMFL27 | 97900 02/26/97 209046 05/15/97 | Uni-ZAP XR | 90 | 1821 | 1203 | 1614 | 1503 | 1503 | 399 | 1 | 30 | 31 | 79 |
| 81 | HMWDN32 | 97900 02/26/97 209046 05/15/97 | Uni-Zap XR | 91 | 862 | 253 | 862 | 359 | 359 | 400 | 1 | 32 | 33 | 36 |
| 82 | HPRAX55 | 97900 02/26/97 209046 05/15/97 | Uni-ZAP XR | 92 | 696 | 349 | 696 | 98 | 98 | 401 | 1 | 30 | 31 | 179 |
| 82 | HPRAX55 | 97900 02/26/97 209046 05/15/97 | Uni-ZAP XR | 248 | 1350 | 265 | 1230 | 348 | 348 | 557 | 1 | 32 | 33 | 58 |
| 83 | HHFFW36 | 97900 02/26/97 209046 05/15/97 | Uni-ZAP XR | 93 | 1886 | 1 | 1759 | 197 | 197 | 402 | 1 | | | 21 |
| 84 | HE2PL77 | 97901 02/26/97 209047 05/15/97 | Uni-ZAP XR | 94 | 1774 | 742 | 1772 | 785 | 785 | 403 | 1 | 21 | 22 | 60 |
| 85 | HSDFV29 | | Uni-ZAP XR | 95 | 1779 | 12 | 1662 | 219 | 219 | 404 | 1 | 36 | 37 | 185 |
| 85 | HSDFV29 | 209076 05/22/97 | Uni-ZAP XR | 249 | 2503 | 1 | 1648 | 206 | 206 | 558 | 1 | 32 | 33 | 151 |
| 85 | HCQAV53 | 97901 02/26/97 209047 05/15/97 | Lambda ZAP II | 250 | 1529 | 72 | 911 | 191 | 191 | 559 | 1 | 20 | 21 | 33 |
| 86 | HTPEG42 | 97901 02/26/97 209047 05/15/97 | Uni-ZAP XR | 96 | 2801 | 418 | 2801 | 234 | 234 | 405 | 1 | 30 | 31 | 479 |
| 86 | HTPEG42 | 97901 02/26/97 209047 05/15/97 | Uni-ZAP XR | 251 | 1537 | 1 | 1537 | 125 | 125 | 560 | 1 | 2I | 22 | 367 |
| 87 | HLHDR57 | 97901 02/26/97 209047 05/15/97 | Uni-ZAP XR | 97 | 1631 | 916 | 1631 | 691 | 691 | 406 | 1 | 38 | 39 | 193 |
| 88 | HAUAV32 | 97901 02/26/97 209047 05/15/97 | Uni-ZAP XR | 98 | 504 | 26 | 504 | /97 | /97 | 407 | 1 | 23 | 24 | 77 |
| 88 | HAUAV32 | 97901 02/26/97 209047 05/15/97 | Uni-ZAP XR | 252 | 506 | 1 | 499 | 183 | 183 | 561 | 1 | 32 | 33 | 77 |
| 89 | HNEBI60 | 97901 02/26/97 209047 05/15/97 | Uni-ZAP XR | 99 | 1416 | 145 | 1416 | 456 | 456 | 408 | 1 | 18 | 19 | 73 |
| 89 | HNEBI60 | 97901 02/26/97 209047 05/15/97 | Uni-ZAP XR | 253 | 1348 | 84 | 1348 | 363 | 363 | 562 | 1 | 21 | 22 | 47 |
| 90 | HSHCJ16 | 97901 | Uni-ZAP XR | 100 | 2847 | 1 | 2847 | | 2 | 409 | 1 | | | 20 |

TABLE 1-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of first AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 91 | HTSEL31 | 02/26/97 209047 05/15/97 97901 | pBluescript | 101 | 1394 | 608 | 1346 | 602 | 602 | 410 | 1 | 23 | 24 | 87 |
| 92 | HAUBL57 | 02/26/97 209047 05/15/97 97901 | Uni-ZAP XR | 102 | 794 | 1 | 794 | 518 | 518 | 411 | 1 | 30 | 31 | 92 |
| 92 | HAUBL57 | 02/26/97 209047 05/15/97 97901 | Uni-ZAP XR | 254 | 1766 | 42 | 1766 | 356 | 356 | 563 | 1 | 30 | 31 | 167 |
| 92 | HAUBL57 | 02/26/97 209047 05/15/97 97901 | Uni-ZAP XR | 255 | 2664 | 47 | 1708 | | 147 | 564 | 1 | 18 | 19 | 124 |
| 93 | HODAS59 | 02/26/97 209047 05/15/97 97901 | Uni-ZAP XR | 103 | 1544 | 898 | 1531 | 975 | 975 | 412 | 1 | | | 21 |
| 94 | HE6CT48 | 02/26/97 209047 05/15/97 97901 | Uni-ZAP XR | 104 | 871 | 106 | 871 | 248 | 248 | 413 | 1 | 34 | 35 | 173 |
| 94 | HE6CT48 | 02/26/97 209047 05/15/97 97901 | Uni-ZAP XR | 256 | 865 | 97 | 865 | 258 | 258 | 565 | 1 | 19 | 20 | 177 |
| 95 | HMDAA61 | 02/26/97 209047 05/15/97 97901 | Uni-ZAP XR | 105 | 404 | 1 | 404 | 16 | 16 | 414 | 1 | 21 | 22 | 63 |
| 95 | HMDAA61 | 02/26/97 209047 05/15/97 97901 | Uni-ZAP XR | 257 | 2082 | 852 | 2074 | 829 | 829 | 566 | 1 | 22 | 23 | 72 |
| 96 | HAQRK61 | 02/26/97 209047 05/15/97 97901 | Uni-ZAP XR | 106 | 1542 | 506 | 1542 | 122 | 122 | 415 | 1 | 51 | 52 | 279 |
| 96 | HAQBK61 | 02/26/97 209047 05/15/97 97901 | Uni-ZAP XR | 258 | 1482 | 508 | 1482 | | 633 | 567 | 1 | 15 | 16 | 45 |
| 96 | HCUHB01 | 209215 08/21/97 | ZAP Express | 259 | 834 | 1 | 834 | 82 | 82 | 568 | 1 | 40 | 41 | 251 |
| 97 | HAQBF73 | 02/26/97 209047 05/15/97 97901 | Uni-ZAP XR | 107 | 2327 | 1528 | 2327 | 465 | 465 | 416 | 1 | 30 | 31 | 283 |
| 97 | HAQBF73 | 02/26/97 209047 05/15/97 97901 | Uni-ZAP XR | 260 | 1508 | 885 | 1508 | | 988 | 569 | 1 | | | 19 |
| 98 | HAQBT94 | 02/26/97 209047 05/15/97 97901 | Uni-ZAP XR | 108 | 1062 | 157 | 1062 | 172 | 172 | 417 | 1 | 28 | 29 | 187 |
| 99 | HETHE07 | 02/26/97 209047 05/15/97 97901 | Uni-ZAP XR | 109 | 2539 | 275 | 2501 | 903 | 903 | 418 | 1 | 30 | 31 | 236 |
| 99 | HETHE07 | 02/26/97 209047 05/15/97 97901 | Uni-ZAP XR | 261 | 2514 | 592 | 2431 | 176 | 176 | 570 | 1 | 30 | 31 | 216 |
| 99 | HETHE07 | 02/26/97 209047 05/15/97 97901 | Uni-ZAP XR | 262 | 2357 | 465 | 2288 | | 1151 | 571 | 1 | 12 | 13 | 82 |

TABLE 1-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of first AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 100 | HLQAB52 | 209047 05/15/97 97901 02/26/97 | Lambda ZAP II | 110 | 1751 | 969 | 1751 | 4 | 4 | 419 | 1 | 46 | 47 | 191 |
| 100 | HLQAB52 | 209047 05/15/97 97901 02/26/97 | Lambda ZAP II | 263 | 689 | 218 | 655 | 314 | 314 | 572 | 1 | 18 | 19 | 95 |
| 100 | HEONN58 | 209119 06/05/97 | pSport1 | 264 | 2377 | 5 | 2377 | 25 | 25 | 573 | 1 | 28 | 29 | 53 |
| 101 | HCRAM28 | 97901 02/26/97 | Uni-ZAP XR | 111 | 1117 | 1 | 1117 | | 1 | 420 | 1 | 19 | 20 | 21 |
| 101 | HIBEK16 | 209047 05/15/97 209627 02/12/98 | Other | 265 | 1193 | 69 | 1135 | 242 | 242 | 574 | 1 | 24 | 25 | 107 |
| 102 | HE2BG03 | 97901 02/26/97 | Uni-ZAP XR | 112 | 1313 | 128 | 1313 | 271 | 271 | 421 | 1 | 30 | 31 | 50 |
| 102 | HE2BG03 | 209047 05/15/97 97901 02/26/97 | Uni-ZAP XR | 266 | 1262 | 26 | 1262 | 35 | 35 | 575 | 1 | 35 | 36 | 50 |
| 103 | HEBDJ82 | 209047 05/15/97 97901 02/26/97 | Uni-ZAP XR | 113 | 1654 | 553 | 1654 | 709 | 709 | 422 | 1 | | | 32 |
| 104 | HCUBC79 | 209047 05/15/97 97901 02/26/97 | ZAP Express | 114 | 1171 | 540 | 1171 | 337 | 337 | 423 | 1 | 30 | 31 | 162 |
| 104 | HCUBC79 | 209047 05/15/97 97901 02/26/97 | ZAP Express | 267 | 1179 | 626 | 1161 | 335 | 335 | 576 | 1 | 30 | 31 | 252 |
| 104 | HCUBC79 | 209047 05/15/97 97901 02/26/97 | ZAP Express | 268 | 1162 | 629 | 1131 | 942 | 942 | 577 | 1 | | | 18 |
| 105 | HSVAF07 | 209047 05/15/97 97901 02/26/97 | Uni-ZAP XR | 115 | 842 | 373 | 800 | 100 | 100 | 424 | 1 | 65 | 66 | 173 |
| 105 | HSVAF07 | 209047 05/15/97 97901 02/26/97 | Uni-ZAP XR | 269 | 735 | 290 | 735 | 25 | 25 | 578 | 1 | 65 | 66 | 80 |
| 105 | HSVAF07 | 209047 05/15/97 97901 02/26/97 | Uni-ZAP XR | 270 | 783 | 416 | 783 | | 413 | 579 | 1 | 33 | 34 | 73 |
| 106 | HT3AM65 | 209047 05/15/97 97901 02/26/97 | Uni-ZAP XR | 116 | 1640 | 187 | 1470 | 581 | 581 | 425 | 1 | 30 | 31 | 49 |
| 106 | HT3AM65 | 209047 05/15/97 97901 02/26/97 | Uni-ZAP XR | 271 | 1638 | 301 | 1405 | 119 | 119 | 580 | 1 | 30 | 31 | 262 |
| 106 | HT3AM65 | 209047 05/15/97 97901 02/26/97 | Uni-ZAP XR | 272 | 1455 | 148 | 1188 | 438 | 438 | 581 | 1 | 24 | 25 | 70 |
| 107 | HE6DK18 | 209047 05/15/97 97901 02/26/97 | Uni-ZAP XR | 117 | 952 | 418 | 906 | 499 | 499 | 426 | 1 | 28 | 29 | 120 |
| 108 | HEBEK93 | 209047 05/15/97 97901 02/26/97 | Uni-ZAP XR | 118 | 1256 | 21 | 1079 | 301 | 301 | 427 | 1 | 30 | 31 | 158 |

TABLE 1-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of first AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 108 | HEBEK93 | 209047 05/15/97 97901 02/26/97 | Uni-ZAP XR | 273 | 1086 | 25 | 1050 | 227 | 227 | 582 | 1 | 23 | 24 | 34 |
| 109 | HJPCM10 | 209047 05/15/97 97901 02/26/97 | Uni-ZAP XR | 119 | 1143 | 171 | 1051 | 175 | 175 | 428 | 1 | 50 | 51 | 153 |
| 109 | HJPCM10 | 209047 05/15/97 97901 02/26/97 | Uni-ZAP XR | 274 | 1003 | 21 | 1003 | 115 | 115 | 583 | 1 | 34 | 35 | 103 |
| 109 | HJPCM10 | 209047 05/15/97 97901 02/26/97 | Uni-ZAP XR | 275 | 1234 | 174 | 1015 | 232 | 232 | 584 | 1 | 27 | 28 | 132 |
| 110 | HSXBL78 | 209047 05/15/97 97901 02/26/97 | Uni-ZAP XR | 120 | 1782 | 1 | 1720 | 138 | 138 | 429 | 1 | 32 | 33 | 204 |
| 111 | HOEAW81 | 209047 05/15/97 97901 02/26/97 | Uni-ZAP XR | 121 | 610 | 18 | 609 | 50 | 50 | 430 | 1 | 30 | 31 | 66 |
| 111 | HOEAW81 | 209047 05/15/97 97901 02/26/97 | Uni-ZAP XR | 276 | 574 | 1 | 566 | 337 | 337 | 585 | 1 | 27 | 28 | 32 |
| 112 | HOEAP41 | 209047 05/15/97 97901 02/26/97 | Uni-ZAP XR | 122 | 526 | 185 | 375 | 143 | 143 | 431 | 1 | 21 | 22 | 25 |
| 113 | HEAAR60 | 209047 05/15/97 97901 02/26/97 | Uni-ZAP XR | 123 | 2081 | 1179 | 1976 | 48 | 48 | 432 | 1 | 30 | 31 | 298 |
| 113 | HEAAR60 | 209047 05/15/97 97901 02/26/97 | Uni-ZAP XR | 277 | 1731 | 889 | 1626 | 886 | 886 | 586 | 1 | 18 | 19 | 28 |
| 114 | HTXG575 | 209047 05/15/97 97902 02/26/97 | Uni-ZAP XR | 124 | 1717 | 764 | 1640 | 898 | 898 | 433 | 1 | 28 | 29 | 86 |
| 115 | HOVBA03 | 209048 05/15/97 97902 02/26/97 | pSport1 | 125 | 804 | 1 | 804 | 145 | 145 | 434 | 1 | 15 | 16 | 197 |
| 115 | HOVBA03 | 209048 05/15/97 97902 02/26/97 | pSport1 | 278 | 1320 | 77 | 637 | 280 | 280 | 587 | 1 | 22 | 23 | 40 |
| 116 | HGBGK76 | 209048 05/15/97 97902 02/26/97 | Uni-ZAP XR | 126 | 431 | 1 | 431 | 73 | 73 | 435 | 1 | 38 | 39 | 46 |
| 116 | HGBGK76 | 209048 05/15/97 97902 02/26/97 | Uni-ZAP XR | 279 | 515 | 1 | 515 | 43 | 43 | 588 | 1 | 20 | 21 | 30 |
| 117 | HBMUW78 | 209048 05/15/97 97902 02/26/97 | Uni-ZAP XR | 127 | 3752 | 3465 | 3752 | 748 | 748 | 436 | 1 | 30 | 31 | 369 |
| 117 | HBMUW78 | 209048 05/15/97 97902 02/26/97 | Uni-ZAP XR | 280 | 2995 | 2738 | 2995 | 2777 | 2777 | 589 | 1 | 18 | 19 | 29 |
| 118 | HASAS24 | 209048 05/15/97 97902 02/26/97 | Uni-ZAP XR | 128 | 1144 | 669 | 1144 | 896 | 896 | 437 | 1 | | | 30 |

TABLE 1-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of first AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 119 | HSIDN55 | 209048 05/15/97 97902 02/26/97 | Uni-ZAP XR | 129 | 1830 | 1234 | 1830 | 1265 | 1265 | 438 | 1 | | | 24 |
| 120 | HGBGZ64 | 209048 05/15/97 97902 02/26/97 | Uni-ZAP XR | 130 | 1864 | 1505 | 1741 | 1578 | 1578 | 439 | 1 | 37 | 38 | 53 |
| 121 | H6EBJ64 | 209048 05/15/97 97902 02/26/97 | Uni-ZAP XR | 131 | 2041 | 1 | 1214 | 46 | 46 | 440 | 1 | 35 | 36 | 175 |
| 121 | H6EBJ64 | 209048 05/15/97 97902 02/26/97 | Uni-ZAP XR | 281 | 1990 | 8 | 1128 | 71 | 71 | 590 | 1 | 16 | 17 | 92 |
| 122 | HOECP43 | 209048 05/15/97 97902 02/26/97 | Uni-ZAP XR | 132 | 2012 | 853 | 1986 | 1127 | 1127 | 441 | 1 | 22 | 23 | 77 |
| 123 | H2CBV31 | 209048 05/15/97 97902 02/26/97 | pBluescript SK- | 133 | 1669 | 670 | 1632 | 962 | 962 | 442 | 1 | 25 | 26 | 32 |
| 124 | HPCAD23 | 209048 05/15/97 97902 02/26/97 | Uni-ZAP XR | 134 | 1565 | 281 | 1565 | 274 | 274 | 443 | 1 | 25 | 26 | 30 |
| 125 | HSPAG15 | 209048 05/15/97 97902 02/26/97 | pSport1 | 135 | 2007 | 1101 | 2007 | 1124 | 1124 | 444 | 1 | 39 | 40 | 69 |
| 126 | HELGH31 | 209048 05/15/97 97902 02/26/97 | Uni-ZAP XR | 136 | 1291 | 1 | 1180 | 911 | 911 | 445 | 1 | 58 | 59 | 63 |
| 127 | HUSHH48 | 209048 05/15/97 97902 02/26/97 | Lambda ZAP II | 137 | 1906 | 1 | 1906 | 184 | 184 | 446 | 1 | 30 | 31 | 42 |
| 127 | HUSHH48 | 209048 05/15/97 97902 02/26/97 | Lambda ZAP II | 282 | 2436 | 572 | 2436 | 726 | 726 | 591 | 1 | 30 | 31 | 42 |
| 128 | HLYAU95 | 209048 05/15/97 97902 02/26/97 | pSport1 | 138 | 1935 | 1044 | 1794 | 1183 | 1183 | 447 | 1 | 18 | 19 | 33 |
| 129 | HHSCV65 | 209048 05/15/97 97902 02/26/97 | Uni-ZAP XR | 139 | 1446 | 572 | 1347 | 585 | 585 | 448 | 1 | 25 | 26 | 53 |
| 130 | HTTAD57 | 209048 05/15/97 97902 02/26/97 | Uni-ZAP XR | 140 | 1109 | 639 | 1109 | 676 | 676 | 449 | 1 | 24 | 25 | 64 |
| 131 | HEBGA37 | 209048 05/15/97 97902 02/26/97 | Uni-ZAP XR | 141 | 497 | 9 | 497 | 95 | 95 | 450 | 1 | | | 34 |
| 132 | HEBFU93 | 209048 05/15/97 97902 02/26/97 | Uni-ZAP XR | 142 | 269 | 1 | 269 | 1 | 1 | 451 | 1 | 30 | 31 | 89 |
| 132 | HEBFU93 | 209048 05/15/97 97902 02/26/97 | Uni-ZAP XR | 283 | 782 | 408 | 781 | | 571 | 592 | 1 | 31 | 32 | 70 |
| 133 | HSGSC60 | 209048 05/15/97 97902 02/26/97 | Lambda ZAP II | 143 | 1269 | 55 | 1262 | 55 | 55 | 452 | 1 | 25 | 26 | 350 |

TABLE 1-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of first AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 134 | HPMGD24 | 209048 05/15/97 97902 02/26/97 | Uni-ZAP XR | 144 | 1944 | 97 | 1871 | 306 | 306 | 453 | 1 | 16 | 17 | 49 |
| 135 | HPTVC60 | 209048 05/15/97 97902 02/26/97 | pBluescript | 145 | 1021 | 526 | 1021 | 74 | 74 | 454 | 1 | 30 | 31 | 277 |
| 135 | HPTVC60 | 209048 05/15/97 97902 02/26/97 | pBluescript | 284 | 961 | 524 | 961 | 545 | 545 | 593 | 1 | 23 | 24 | 110 |
| 136 | HSKNE18 | 209048 05/15/97 97902 02/26/97 | pBluescript | 146 | 1285 | 5 | 1285 | 116 | 116 | 455 | 1 | 30 | 31 | 198 |
| 136 | HSKNE18 | 209048 05/15/97 97902 02/26/97 | pBluescript | 285 | 1228 | 9 | 1228 | 324 | 324 | 594 | 1 | 26 | 27 | 30 |
| 137 | HMWIF35 | 209048 05/15/97 97902 02/26/97 | Uni-Zap XR | 147 | 1386 | 169 | 1272 | 165 | 165 | 456 | 1 | 30 | 31 | 257 |
| 137 | HMWIF35 | 209048 05/15/97 97902 02/26/97 | Uni-Zap XR | 286 | 1327 | 169 | 1208 | 160 | 160 | 595 | 1 | 23 | 24 | 71 |
| 138 | HMWGI25 | 209048 05/15/97 97902 02/26/97 | Uni-Zap XR | 148 | 2098 | 721 | 2044 | 784 | 784 | 457 | 1 | 18 | 19 | 87 |
| 139 | HSKGF03 | 209048 05/15/97 97902 02/26/97 | pBluescript | 149 | 1847 | 1689 | 1847 | 241 | 241 | 458 | 1 | 33 | 34 | 314 |
| 139 | HSKGF03 | 209048 05/15/97 97902 02/26/97 | pBluescript | 287 | 1847 | 1033 | 1847 | 243 | 243 | 596 | 1 | 30 | 31 | 123 |
| 139 | HSKGF03 | 209048 05/15/97 97902 02/26/97 | pBluescript | 288 | 799 | 1 | 799 |  | 243 | 597 | 1 | 12 | 13 | 47 |
| 140 | HMSKE75 | 209048 05/15/97 97902 02/26/97 | Uni-ZAP XR | 150 | 1569 | 113 | 1517 | 417 | 417 | 459 | 1 | 21 | 22 | 52 |
| 141 | HCMSH30 | 209048 05/15/97 97902 02/26/97 | Uni-ZAP XR | 151 | 1540 | 538 | 1540 | 48 | 48 | 460 | 1 | 30 | 31 | 382 |
| 141 | HCMSH30 | 209048 05/15/97 97902 02/26/97 | Uni-ZAP XR | 289 | 2196 | 270 | 2196 | 294 | 294 | 598 | 1 | 32 | 33 | 39 |
| 142 | HTWCB92 | 209048 05/15/97 97902 02/26/97 | pSport1 | 152 | 1719 | 690 | 1575 | 6 | 6 | 461 | 1 | 52 | 53 | 186 |
| 143 | HBMDM46 | 209048 05/15/97 97902 02/26/97 | pBluescript | 153 | 863 | 1 | 863 | 195 | 195 | 462 | 1 | 26 | 27 | 162 |
| 143 | HBMDM46 | 209048 05/15/97 97902 02/26/97 | pBluescript | 290 | 1185 | 277 | 1166 | 621 | 621 | 599 | 1 |  |  | 19 |
| 144 | HFAMG13 | 209048 05/15/97 97902 02/26/97 | Uni-ZAP XR | 154 | 1101 | 1 | 512 | 40 | 40 | 463 | 1 | 21 | 22 | 46 |

TABLE 1-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of first AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 145 | HFXHL79 | 209048 05/15/97 97903 02/26/97 | Lambda ZAP II | 155 | 2031 | 669 | 2031 | 411 | 411 | 464 | 1 | 23 | 24 | 104 |
| 145 | HFXHL79 | 209049 05/15/97 97903 02/26/97 | Lambda ZAP II | 291 | 1634 | 615 | 1485 | 878 | 878 | 600 | 1 | 20 | 21 | 23 |
| 146 | HSNAK17 | 209049 05/15/97 97903 02/26/97 | Uni-ZAP XR | 156 | 1981 | 1458 | 1809 | 1592 | 1592 | 465 | 1 | 23 | 24 | 69 |
| 146 | HSNAK17 | 209049 05/15/97 97903 02/26/97 | Uni-ZAP XR | 292 | 1795 | 1458 | 1749 | 1562 | 1562 | 601 | 1 | 33 | 34 | 69 |
| 147 | HCFBC03 | 209049 05/15/97 97903 02/26/97 | pSport1 | 157 | 915 | 45 | 912 | 22 | 22 | 466 | 1 | 22 | 23 | 154 |
| 147 | HCFBC03 | 209049 05/15/97 97903 02/26/97 | pSport1 | 293 | 858 | 46 | 858 | 224 | 224 | 602 | 1 | 30 | 31 | 77 |
| 147 | HSJAP03 | 209049 05/15/97 97903 02/26/97 | Uni-ZAP XR | 294 | 915 | 1 | 915 | 22 | 22 | 603 | 1 | 22 | 23 | 154 |
| 148 | HSKG026 | 209139 07/03/97 97903 02/26/97 | pBluescript | 158 | 2117 | 51 | 1422 | 32 | 32 | 467 | 1 | 23 | 24 | 332 |
| 149 | HCQAV96 | 209049 05/15/97 97903 02/26/97 | Lambda ZAP II | 159 | 2395 | 14 | 887 | 722 | 722 | 468 | 1 | 22 | 23 | 48 |
| 150 | HSHCC16 | 209049 05/15/97 97903 02/26/97 | Uni-ZAP XR | 160 | 2120 | 1223 | 2108 | 317 | 317 | 469 | 1 | 51 | 52 | 548 |
| 151 | HTLEF62 | 209049 05/15/97 97903 02/26/97 | Uni-ZAP XR | 161 | 900 | 482 | 900 | 46 | 46 | 470 | 1 | 30 | 31 | 285 |
| 151 | HTLEF62 | 209049 05/15/97 97903 02/26/97 | Uni-ZAP XR | 295 | 1517 | 783 | 1517 | 1062 | 1062 | 604 | 1 | | | 24 |
| 152 | HTLAD94 | 209049 05/15/97 97903 02/26/97 | Uni-ZAP XR | 162 | 1003 | 1 | 1003 | 288 | 288 | 471 | 1 | 30 | 31 | 79 |
| 152 | HTLAD94 | 209049 05/15/97 97903 02/26/97 | Uni-ZAP XR | 296 | 3865 | 217 | 1195 | 281 | 281 | 605 | 1 | 16 | 17 | 38 |
| 153 | HTSFQ12 | 209049 05/15/97 97903 02/26/97 | pBluescript | 163 | 2196 | 1607 | 2180 | 1611 | 1611 | 472 | 1 | 30 | 31 | 47 |
| 154 | HE6FL83 | 209049 05/15/97 97903 02/26/97 | Uni-ZAP XR | 164 | 1945 | 271 | 1840 | 299 | 299 | 473 | 1 | 63 | 64 | 95 |
| 154 | RE6FL83 | 209049 05/15/97 97903 02/26/97 | Uni-ZAP XR | 297 | 1910 | 279 | 1818 | 355 | 355 | 606 | 1 | 39 | 40 | 69 |
| 155 | HTXFJ55 | 209049 05/15/97 97903 02/26/97 | Uni-ZAP XR | 165 | 2933 | 489 | 2871 | 258 | 258 | 474 | 1 | 30 | 31 | 398 |

TABLE 1-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of first AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 155 | HTXFJS5 | 97903 02/26/97 209049 05/15/97 | Uni-ZAP XR | 298 | 3276 | 486 | 2838 | | 525 | 607 | 1 | 45 | 46 | 308 |
| 156 | HJPCJ76 | 97903 02/26/97 209049 05/15/97 | Uni-ZAP XR | 166 | 2243 | 343 | 2221 | 1311 | 1311 | 475 | 1 | 20 | 21 | 45 |
| 157 | HLTED27 | 97903 02/26/97 209049 05/15/97 | Uni-ZAP XR | 167 | 1816 | 1130 | 1816 | 284 | 284 | 476 | 1 | 31 | 32 | 272 |
| 157 | HLTED27 | 97903 02/26/97 209049 05/15/97 | Uni-ZAP XR | 299 | 1695 | 1098 | 1548 | 1306 | 1306 | 608 | 1 | | | 22 |
| 158 | HMKBA64 | 97903 02/26/97 209049 05/15/97 | pSport1 | 168 | 945 | 1 | 787 | 208 | 208 | 477 | 1 | 18 | 19 | 192 |
| 159 | HNFIP24 | 97903 02/26/97 209049 05/15/97 | pBluescript | 169 | 902 | 46 | 816 | 19 | 19 | 478 | 1 | 26 | 27 | 234 |
| 160 | HCELB21 | 97903 02/26/97 209049 05/15/97 | Uni-ZAP XR | 170 | 1883 | 798 | 1869 | 1001 | 1001 | 479 | 1 | 45 | 46 | 104 |
| 160 | HCELB21 | 97903 02/26/97 209049 05/15/97 | Uni-ZAP XR | 300 | 1501 | 438 | 1501 | 510 | 510 | 609 | 1 | | | 24 |
| 161 | HAWBA28 | 97903 02/26/97 209049 05/15/97 | pBluescript SK- | 171 | 2100 | 1642 | 2100 | 1722 | 1722 | 480 | 1 | 23 | 24 | 32 |
| 162 | HSAAS44 | 97903 02/26/97 209049 05/15/97 | pBluescript SK- | 172 | 1930 | 187 | 1930 | 65 | 65 | 481 | 1 | 30 | 31 | 570 |
| 162 | HSAAS44 | 97903 02/26/97 209049 05/15/97 | pBluescript SK- | 301 | 2683 | 183 | 2683 | 431 | 431 | 610 | 1 | | | 24 |
| 163 | HAFAL73 | 97903 02/26/97 209049 05/15/97 | pBluescript SK- | 173 | 1509 | 962 | 1451 | 122 | 122 | 482 | 1 | 30 | 31 | 311 |
| 163 | HAFAL73 | 97903 02/26/97 209049 05/15/97 | pBluescript SK- | 302 | 1454 | 961 | 1420 | 976 | 976 | 611 | 1 | | | 1 |
| 164 | HSAWF26 | 97903 02/26/97 209049 05/15/97 | Uni-ZAP XR | 174 | 3173 | 2/97 | 2972 | 51 | 51 | 483 | 1 | 21 | 22 | 328 |
| 164 | HSAWF26 | 97903 02/26/97 209049 05/15/97 | Uni-ZAP XR | 303 | 828 | 52 | 828 | 305 | 305 | 612 | 1 | | | 8 |
| 165 | HEAAL31 | 97903 02/26/97 209049 05/15/97 | Uni-ZAP XR | 175 | 991 | 374 | 970 | 60 | 60 | 484 | 1 | 24 | 25 | 177 |
| 165 | HEAAL31 | 97903 02/26/97 209049 05/15/97 | Uni-ZAP XR | 304 | 2416 | 1387 | 2413 | 1473 | 1473 | 613 | 1 | 18 | 19 | 25 |
| 166 | HFKFX55 | 97903 02/26/97 209049 05/15/97 | Uni-ZAP XR | 176 | 1290 | 499 | 1290 | 130 | 130 | 485 | 1 | 19 | 20 | 238 |

TABLE 1-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of first AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 167 | H2LAO11 | 97903 02/26/97 209049 05/15/97 | pBluescript | 177 | 2290 | 1 | 2290 | 173 | 173 | 486 | 1 | 22 | 23 | 62 |
| 168 | HPFDZ95 | 97903 02/26/97 209049 05/15/97 | Uni-ZAP XR | 178 | 549 | 1 | 549 | 11 | 11 | 487 | 1 | 21 | 22 | 27 |
| 168 | HPFDZ95 | 97903 02/26/97 209049 05/15/97 | Uni-ZAP XR | 305 | 545 | 1 | 545 | 17 | 17 | 614 | 1 | 21 | 22 | 27 |
| 169 | HPTTU11 | 97904 02/26/97 209050 05/15/97 | Uni-ZAP XR | 179 | 1509 | 294 | 1352 | 92 | 92 | 488 | 1 | 30 | 31 | 338 |
| 169 | HPTTU11 | 97904 02/26/97 209050 05/15/97 | Uni-ZAP XR | 306 | 1530 | 385 | 1530 | 562 | 562 | 615 | 1 | 23 | 24 | 61 |
| 170 | HCFAE79 | 97904 02/26/97 209050 05/15/97 | pSport1 | 180 | 1316 | 985 | 1250 | 995 | 995 | 489 | 1 | 26 | 27 | 32 |
| 171 | HTED134 | 97904 02/26/97 209050 05/15/97 | Uni-ZAP XR | 181 | 777 | 1 | 777 | 51 | 51 | 490 | 1 | 30 | 31 | 47 |
| 171 | HTEDJ34 | 97904 02/26/97 209050 05/15/97 | Uni-ZAP XR | 307 | 997 | 244 | 997 | 300 | 300 | 616 | 1 | 23 | 24 | 29 |
| 172 | HODCW06 | 97904 02/26/97 209050 05/15/97 | Uni-ZAP XR | 182 | 791 | 1 | 791 | 14 | 14 | 491 | 1 | 29 | 30 | 38 |
| 173 | HFTAR26 | 97904 02/26/97 209050 05/15/97 | Uni-ZAP XR | 183 | 1405 | 346 | 1405 | 575 | 575 | 492 | 1 | 20 | 21 | 61 |
| 174 | H2MBF44 | 97904 02/26/97 209050 05/15/97 | pBluescript SK- | 184 | 1596 | 75 | 1596 | 131 | 131 | 493 | 1 | 24 | 25 | 345 |
| 174 | H2MBF44 | 97904 02/26/97 209050 05/15/97 | pBluescript SK- | 308 | 2345 | 75 | 2345 | 233 | 233 | 617 | 1 | 56 | 57 | 69 |
| 175 | HE8B192 | 97904 02/26/97 209050 05/15/97 | Uni-ZAP XR | 185 | 2293 | 355 | 2288 | 67 | 67 | 494 | 1 | 30 | 31 | 236 |
| 175 | HE8BI92 | 97904 02/26/97 209050 05/15/97 | Uni-ZAP XR | 309 | 2369 | 2 | 1946 | | 60 | 618 | 1 | 9 | 10 | 24 |
| 176 | HFTBR48 | 97904 02/26/97 209050 05/15/97 | Uni-ZAP XR | 186 | 1212 | 462 | 1180 | 257 | 257 | 495 | 1 | 30 | 31 | 199 |
| 176 | HFTBR48 | 97904 02/26/97 209050 05/15/97 | Uni-ZAP XR | 310 | 1181 | 424 | 1149 | 663 | 663 | 619 | 1 | 23 | 24 | 35 |
| 177 | HE9CM64 | 97904 02/26/97 209050 05/15/97 | Uni-ZAP XR | 187 | 1605 | 770 | 1554 | 166 | 166 | 496 | 1 | 30 | 31 | 350 |
| 177 | HE9CM64 | 97904 02/26/97 209050 05/15/97 | Uni-ZAP XR | 311 | 1537 | 719 | 1515 | | 787 | 620 | 1 | 43 | 44 | 130 |

TABLE 1-continued

| Gene No. | cDNA Clone ID | ATCC Deposit Nr and Date | Vector | NT SEQ ID NO: X | Total NT Seq. | 5' NT of Clone Seq. | 3' NT of Clone Seq. | 5' NT of Start Codon | 5' NT of first AA of Signal Pep | AA SEQ ID NO: Y | First AA of Sig Pep | Last AA of Sig Pep | First AA of Secreted Portion | Last AA of ORF |
|---|---|---|---|---|---|---|---|---|---|---|---|---|---|---|
| 178 | HATAV51 | 97904 02/26/97 209050 05/15/97 | Uni-ZAP XR | 188 | 1516 | 960 | 1516 | 8 | 8 | 497 | 1 | 30 | 31 | 264 |
| 178 | HATAV51 | 97904 02/26/97 209050 05/15/97 | Uni-ZAP XR | 312 | 1493 | 1 | 1261 | 54 | 54 | 621 | 1 | 18 | 19 | 23 |
| 179 | HAQAF27 | 97904 02/26/97 209050 05/15/97 | Uni-ZAP XR | 189 | 681 | 287 | 681 | | 401 | 498 | 1 | | | 25 |
| 180 | HCEEK08 | 97904 02/26/97 209050 05/15/97 | Uni-ZAP XR | 190 | 1014 | 703 | 1014 | 360 | 360 | 499 | 1 | 30 | 31 | 158 |
| 180 | HCFEK08 | 97904 02/26/97 209050 05/15/97 | Uni-ZAP XR | 313 | 577 | 1 | 577 | | 175 | 622 | 1 | | | 6 |
| 181 | HAFAU18 | 97904 02/26/97 209050 05/15/97 | pBluescript SK- | 191 | 2779 | 2207 | 2630 | 1153 | 1153 | 500 | 1 | 30 | 31 | 278 |
| 181 | HAFAU18 | 97904 02/26/97 209050 05/15/97 | pBluescript SK- | 314 | 2860 | 163 | 2860 | 21 | 21 | 623 | 1 | 30 | 31 | 231 |
| 181 | HAFAU18 | 97904 02/26/97 209050 05/15/97 | pBluescript SK- | 315 | 876 | 275 | 876 | 302 | 302 | 624 | 1 | 32 | 33 | 34 |
| 182 | HETBY74 | 97904 02/26/97 209050 05/15/97 | Uni-ZAP XR | 192 | 1923 | 30 | 1923 | 45 | 45 | 501 | 1 | 33 | 34 | 193 |
| 183 | HTOAF35 | 97904 02/26/97 209050 05/15/97 | Uni-ZAP XR | 193 | 2346 | 1160 | 2286 | 178 | 178 | 502 | 1 | 30 | 31 | 204 |
| 183 | HTOAF35 | 97904 02/26/97 209050 05/15/97 | Uni-ZAP XR | 316 | 2025 | 840 | 2025 | 971 | 971 | 625 | 1 | 18 | 19 | 21 |
| 184 | HCRBX32 | 97904 02/26/97 209050 05/15/97 | Uni-ZAP XR | 194 | 3054 | 2004 | 3054 | 434 | 434 | 503 | 1 | 11 | 12 | 146 |
| 184 | HCRBX32 | 97904 02/26/97 209050 05/15/97 | Uni-ZAP XR | 317 | 3026 | 1966 | 3026 | | 2131 | 626 | 1 | | | 9 |
| 185 | HEBGB80 | 97904 02/26/97 209050 05/15/97 | Uni-ZAP XR | 195 | 907 | 152 | 907 | 297 | 297 | 504 | 1 | 30 | 31 | 63 |
| 185 | HEBGB80 | 97904 02/26/97 209050 05/15/97 | Uni-ZAP XR | 318 | 712 | 67 | 712 | 107 | 107 | 627 | 1 | 18 | 19 | 29 |
| 186 | HFAMH74 | 97904 02/26/97 209050 05/15/97 | Uni-ZAP XR | 196 | 1290 | 84 | 809 | 225 | 225 | 505 | 1 | 30 | 31 | 93 |
| 186 | HFAMH74 | 97904 02/26/97 209050 05/15/97 | Uni-ZAP XR | 319 | 1289 | 785 | 1289 | 927 | 927 | 628 | 1 | 28 | 29 | 30 |

Table 1 summarizes the information corresponding to each "Gene No." described above. The nucleotide sequence identified as "NT SEQ ID NO:X" was assembled from partially homologous ("overlapping") sequences obtained from the "cDNA clone ID" identified in Table 1 and, in some cases, from additional related DNA clones. The overlapping sequences were assembled into a single contiguous sequence of high redundancy (usually three to five overlapping sequences at each nucleotide position), resulting in a final sequence identified as SEQ ID NO:X.

The cDNA Clone ID was deposited on the date and given the corresponding deposit number listed in "ATCC Deposit No:Z and Date." Some of the deposits contain multiple different clones corresponding to the same gene. "Vector" refers to the type of vector contained in the cDNA Clone ID.

"Total NT Seq." refers to the total number of nucleotides in the contig identified by "Gene No." The deposited clone may contain all or most of these sequences, reflected by the nucleotide position indicated as "5' NT of Clone Seq." and the "3' NT of Clone Seq." of SEQ ID NO:X. The nucleotide position of SEQ ID NO:X of the putative start codon (methionine) is identified as "5' NT of Start Codon." Similarly, the nucleotide position of SEQ ID NO:X of the predicted signal sequence is identified as "5' NT of First AA of Signal Pep."

The translated amino acid sequence, beginning with the methionine, is identified as "AA SEQ ID NO:Y," although other reading frames can also be easily translated using known molecular biology techniques. The polypeptides produced by these alternative open reading frames are specifically contemplated by the present invention.

The first and last amino acid position of SEQ ID NO:Y of the predicted signal peptide is identified as "First AA of Sig Pep" and "Last AA of Sig Pep." The predicted first amino acid position of SEQ ID NO:Y of the secreted portion is identified as "Predicted First AA of Secreted Portion." Finally, the amino acid position of SEQ ID NO:Y of the last amino acid in the open reading frame is identified as "Last AA of ORF."

SEQ ID NO:X and the translated SEQ ID NO:Y are sufficiently accurate and otherwise suitable for a variety of uses well known in the art and described further below. For instance, SEQ ID NO:X is useful for designing nucleic acid hybridization probes that will detect nucleic acid sequences contained in SEQ ID NO:X or the cDNA contained in the deposited clone. These probes will also hybridize to nucleic acid molecules in biological samples, thereby enabling a variety of forensic and diagnostic methods of the invention. Similarly, polypeptides identified from SEQ ID NO:Y may be used to generate antibodies which bind specifically to the secreted proteins encoded by the cDNA clones identified in Table 1.

Nevertheless, DNA sequences generated by sequencing reactions can contain sequencing errors. The errors exist as misidentified nucleotides, or as insertions or deletions of nucleotides in the generated DNA sequence. The erroneously inserted or deleted nucleotides cause frame shifts in the reading frames of the predicted amino acid sequence. In these cases, the predicted amino acid sequence diverges from the actual amino acid sequence, even though the generated DNA sequence may be greater than 99.9% identical to the actual DNA sequence (for example, one base insertion or deletion in an open reading frame of over 1000 bases).

Accordingly, for those applications requiring precision in the nucleotide sequence or the amino acid sequence, the present invention provides not only the generated nucleotide sequence identified as SEQ ID NO:X and the predicted translated amino acid sequence identified as SEQ ID NO:Y, but also a sample of plasmid DNA containing a human cDNA of the invention deposited with the ATCC, as set forth in Table 1. The nucleotide sequence of each deposited clone can readily be determined by sequencing the deposited clone in accordance with known methods. The predicted amino acid sequence can then be verified from such deposits. Moreover, the amino acid sequence of the protein encoded by a particular clone can also be directly determined by peptide sequencing or by expressing the protein in a suitable host cell containing the deposited human cDNA, collecting the protein, and determining its sequence.

The present invention also relates to the genes corresponding to SEQ ID NO:X, SEQ ID NO:Y, or the deposited clone. The corresponding gene can be isolated in accordance with known methods using the sequence information disclosed herein. Such methods include preparing probes or primers from the disclosed sequence and identifying or amplifying the corresponding gene from appropriate sources of genomic material.

Also provided in the present invention are species homologs. Species homologs may be isolated and identified by making suitable probes or primers from the sequences provided herein and screening a suitable nucleic acid source for the desired homologue.

The polypeptides of the invention can be prepared in any suitable manner. Such polypeptides include isolated naturally occurring polypeptides, recombinantly produced polypeptides, synthetically produced polypeptides, or polypeptides produced by a combination of these methods. Means for preparing such polypeptides are well understood in the art.

The polypeptides may be in the form of the secreted protein, including the mature form, or may be a part of a larger protein, such as a fusion protein (see below). It is often advantageous to include an additional amino acid sequence which contains secretory or leader sequences, pro-sequences, sequences which aid in purification, such as multiple histidine residues, or an additional sequence for stability during recombinant production.

The polypeptides of the present invention are preferably provided in an isolated form, and preferably are substantially purified. A recombinantly produced version of a polypeptide, including the secreted polypeptide, can be substantially purified by the one-step method described in Smith and Johnson, Gene 67:31–40 (1988). Polypeptides of the invention also can be purified from natural or recombinant sources using antibodies of the invention raised against the secreted protein in methods which are well known in the art.

Signal Sequences

Methods for predicting whether a protein has a signal sequence, as well as the cleavage point for that sequence, are available. For instance, the method of McGeoch, Virus Res. 3:271–286 (1985), uses the information from a short N-terminal charged region and a subsequent uncharged region of the complete (uncleaved) protein. The method of von Heinje, Nucleic Acids Res. 14:4683–4690 (1986) uses the information from the residues surrounding the cleavage site, typically residues −13 to +2, where +1 indicates the amino terminus of the secreted protein. The accuracy of predicting the cleavage points of known mammalian secretory proteins for each of these methods is in the range of 75–80%. (von Heinje, supra.) However, the two methods do not always produce the same predicted cleavage point(s) for a given protein.

In the present case, the deduced amino acid sequence of the secreted polypeptide was analyzed by a computer program called SignalP (Henrik Nielsen et al., Protein Engineering 10:1–6 (1997)), which predicts the cellular location of a protein based on the amino acid sequence. As part of this computational prediction of localization, the methods of McGeoch and von Heinje are incorporated. The analysis of the amino acid sequences of the secreted proteins described herein by this program provided the results shown in Table 1.

As one of ordinary skill would appreciate, however, cleavage sites sometimes vary from organism to organism and cannot be predicted with absolute certainty. Accordingly, the present invention provides secreted polypeptides having a sequence shown in SEQ ID NO:Y which have an N-terminus beginning within 5 residues (i.e., +or −5 residues) of the predicted cleavage point. Similarly, it is also recognized that in some cases, cleavage of the signal sequence from a secreted protein is not entirely uniform, resulting in more than one secreted species. These polypeptides, and the polynucleotides encoding such polypeptides, are contemplated by the present invention.

Moreover, the signal sequence identified by the above analysis may not necessarily predict the naturally occurring signal sequence. For example, the naturally occurring signal sequence may be further upstream from the predicted signal sequence. However, it is likely that the predicted signal sequence will be capable of directing the secreted protein to the ER. These polypeptides, and the polynucleotides encoding such polypeptides, are contemplated by the present invention.

Polynucleotide and Polypeptide Variants

"Variant" refers to a polynucleotide or polypeptide differing from the polynucleotide or polypeptide of the present invention, but retaining essential properties thereof. Generally, variants are overall closely similar, and, in many regions, identical to the polynucleotide or polypeptide of the present invention.

By a polynucleotide having a nucleotide sequence at least, for example, 95% "identical" to a reference nucleotide sequence of the present invention, it is intended that the nucleotide sequence of the polynucleotide is identical to the reference sequence except that the polynucleotide sequence may include up to five point mutations per each 100 nucleotides of the reference nucleotide sequence encoding the polypeptide. In other words, to obtain a polynucleotide having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence. The query sequence may be an entire sequence shown in Table 1, the ORF (open reading frame), or any fragement specified as described herein.

As a practical matter, whether any particular nucleic acid molecule or polypeptide is at least 90%, 95%, 96%, 97%, 98% or 99% identical to a nucleotide sequence of the presence invention can be determined conventionally using known computer programs. A preferred method for determining the best overall match between a query sequence (a sequence of the present invention) and a subject sequence, also referred to as a global sequence alignment, can be determined using the FASTDB computer program based on the algorithm of Brutlag et al. (Comp. App. Biosci. (1990) 6:237–245). In a sequence alignment the query and subject sequences are both DNA sequences. An RNA sequence can be compared by converting U's to T's. The result of said global sequence alignment is in percent identity. Preferred parameters used in a FASTDB alignment of DNA sequences to calculate percent identiy are: Matrix=Unitary, k-tuple=4, Mismatch Penalty=1, Joining Penalty=30, Randomization Group Length=0, Cutoff Score=1, Gap Penalty=5, Gap Size Penalty 0.05, Window Size=500 or the lenght of the subject nucleotide sequence, whichever is shorter.

If the subject sequence is shorter than the query sequence because of 5' or 3' deletions, not because of internal deletions, a manual correction must be made to the results. This is becuase the FASTDB program does not account for 5' and 3' truncations of the subject sequence when calculating percent identity. For subject sequences truncated at the 5' or 3' ends, relative to the the query sequence, the percent identity is corrected by calculating the number of bases of the query sequence that are 5' and 3' of the subject sequence, which are not matched/aligned, as a percent of the total bases of the query sequence. Whether a nucleotide is matched/aligned is determined by results of the FASTDB sequence alignment. This percentage is then subtracted from the percent identity, calculated by the above FASTDB program using the specified parameters, to arrive at a final percent identity score. This corrected score is what is used for the purposes of the present invention. Only bases outside the 5' and 3' bases of the subject sequence, as displayed by the FASTDB alignment, which are not matched/aligned with the query sequence, are calculated for the purposes of manually adjusting the percent identity score.

For example, a 90 base subject sequence is aligned to a 100 base query sequence to determine percent identity. The deletions occur at the 5' end of the subject sequence and therefore, the FASTDB alignment does not show a matched/alignement of the first 10 bases at 5' end. The unpaired bases represent 10% of the sequence (number of bases at the 5' and 3' ends not matched/total number of bases in the query sequence) so 10% is subtracted from the percent identity score calculated by the FASTDB program. If the remaining 90 bases were perfectly matched the final percent identity would be 90%. In another example, a 90 base subject sequence is compared with a 100 base query sequence. This time the deletions are internal deletions so that there are no bases on the 5' or 3' of the subject sequence which are not matched/aligned with the query. In this case the percent identity calculated by FASTDB is not manually corrected. Once again, only bases 5' and 3' of the subject sequence which are not matched/aligned with the query sequnce are manually corrected for. No other manual corrections are to made for the purposes of the present invention.

By a polypeptide having an amino acid sequence at least, for example, 95% "identical" to a query amino acid sequence of the present invention, it is intended that the amino acid sequence of the subject polypeptide is identical to the query sequence except that the subject polypeptide sequence may include up to five amino acid alterations per each 100 amino acids of the query amino acid sequence. In other words, to obtain a polypeptide having an amino acid sequence at least 95% identical to a query amino acid sequence, up to 5% of the amino acid residues in the subject sequence may be inserted, deleted, (indels) or substituted with another amino acid. These alterations of the reference sequence may occur at the amino or carboxy terminal positions of the reference amino acid sequence or anywhere between those terminal positions, interspersed either individually among residues in the reference sequence or in one or more contiguous groups within the reference sequence.

As a practical matter, whether any particular polypeptide is at least 90%, 95%, 96%, 97%, 98% or 99% identical to, for instance, the amino acid sequences shown in Table 1 or to the amino acid sequence encoded by deposited DNA clone can be determined conventionally using known computer programs. A preferred method for determining the best overall match between a query sequence (a sequence of the present invention) and a subject sequence, also referred to as a global sequence alignment, can be determined using the FASTDB computer program based on the algorithm of Brutlag et al. (Comp. App. Biosci. (1990) 6:237–245). In a sequence alignment the query and subject sequences are either both nucleotide sequences or both amino acid sequences. The result of said global sequence alignment is in percent identity. Preferred parameters used in a FASTDB amino acid alignment are: Matrix=PAM 0, k-tuple=2, Mismatch Penalty=1, Joining Penalty=20, Randomization Group Length=0, Cutoff Score=l, Window Size=sequence length, Gap Penalty=5, Gap Size Penalty=0.05, Window Size=500 or the length of the subject amino acid sequence, whichever is shorter.

If the subject sequence is shorter than the query sequence due to N- or C-terminal deletions, not because of internal deletions, a manual correction must be made to the results. This is becuase the FASTDB program does not account for N- and C-terminal truncations of the subject sequence when calculating global percent identity. For subject sequences truncated at the N- and C-termini, relative to the the query sequence, the percent identity is corrected by calculating the number of residues of the query sequence that are N- and C-terminal of the subject sequence, which are not matched/aligned with a corresponding subject residue, as a percent of the total bases of the query sequence. Whether a residue is matched/aligned is determined by results of the FASTDB sequence alignment. This percentage is then subtracted from the percent identity, calculated by the above FASTDB program using the specified parameters, to arrive at a final percent identity score. This final percent identity score is what is used for the purposes of the present invention. Only residues to the N- and C-termini of the subject sequence, which are not matched/aligned with the query sequence, are considered for the purposes of manually adjusting the percent identity score. That is, only query residue positions outside the farthest N- and C- terminal residues of the subject sequence.

For example, a 90 amino acid residue subject sequence is aligned with a 100 residue query sequence to determine percent identity. The deletion occurs at the N-terminus of the subject sequence and therefore, the FASTDB alignment does not show a matching/alignment of the first residues at the N-terminus. The 10 unpaired residues represent 10% of the sequence (number of residues at the N- and C-termini not matched/total number of residues in the query sequence) so 10% is subtracted from the percent identity score calculated by the FASTDB program. If the remaining 90 residues were perfectly matched the final percent identity would be 90%. In another example, a 90 residue subject sequence is compared with a 100 residue query sequence. This time the deletions are internal deletions so there are no residues at the N- or C-termini of the subject sequence which are not matched/aligned with the query. In this case the percent identity calculated by FASTDB is not manually corrected. Once again, only residue positions outside the N- and C-terminal ends of the subject sequence, as displayed in the FASTDB alignment, which are not matched/aligned with the query sequnce are manually corrected for. No other manual corrections are to made for the purposes of the present invention.

The variants may contain alterations in the coding regions, non-coding regions, or both. Especially preferred are polynucleotide variants containing alterations which produce silent substitutions, additions, or deletions, but do not alter the properties or activities of the encoded polypeptide. Nucleotide variants produced by silent substitutions due to the degeneracy of the genetic code are preferred. Moreover, variants in which 5–10, 1–5, or 1–2 amino acids are substituted, deleted, or added in any combination are also preferred. Polynucleotide variants can be produced for a variety of reasons, e.g. to optimize codon expression for a particular host (change codons in the human MRNA to those preferred by a bacterial host such as E. coli).

Naturally occurring variants are called "allelic variants," and refer to one of several alternate forms of a gene occupying a given locus on a chromosome of an organism. (Genes II, Lewin, B., ed., John Wiley & Sons, New York (1985).) These allelic variants can vary at either the polynucleotide and/or polypeptide level. Alternatively, non-naturally occurring variants may be produced by mutagenesis techniques or by direct synthesis.

Using known methods of protein engineering and recombinant DNA technology, variants may be generated to improve or alter the characteristics of the polypeptides of the present invention. For instance, one or more amino acids can be deleted from the N-terminus or C-terminus of the secreted protein without substantial loss of biological function. The authors of Ron et al., J. Biol. Chem. 268: 2984–2988 (1993), reported variant KGF proteins having heparin binding activity even after deleting 3, 8, or 27 amino-terminal amino acid residues. Similarly, Interferon gamma exhibited up to ten times higher activity after deleting 8–10 amino acid residues from the carboxy terminus of this protein. (Dobeli et al., J. Biotechnology 7:199–216 (1988).) Moreover, ample evidence demonstrates that variants often retain a biological activity similar to that of the naturally occurring protein. For example, Gayle and coworkers (J. Biol. Chem 268:22105–22111 (1993)) conducted extensive mutational analysis of human cytokine IL-la. They used random mutagenesis to generate over 3,500 individual IL-la mutants that averaged 2.5 amino acid changes per variant over the entire length of the molecule. Multiple mutations were examined at every possible amino acid position. The investigators found that "[m]ost of the molecule could be altered with little effect on either [binding or biological activity]." (See, Abstract.) In fact, only 23 unique amino acid sequences, out of more than 3,500 nucleotide sequences examined, produced a protein that significantly differed in activity from wild-type.

Furthermore, even if deleting one or more amino acids from the N-terminus or C-terminus of a polypeptide results in modification or loss of one or more biological functions, other biological activities may still be retained. For example, the ability of a deletion variant to induce and/or to bind antibodies which recognize the secreted form will likely be retained when less than the majority of the residues of the secreted form are removed from the N-terminus or C-terminus. Whether a particular polypeptide lacking N- or C-terminal residues of a protein retains such immunogenic activities can readily be determined by routine methods described herein and otherwise known in the art.

Thus, the invention further includes polypeptide variants which show substantial biological activity. Such variants include deletions, insertions, inversions, repeats, and substitutions selected according to general rules known in the art so as have little effect on activity. For example, guidance concerning how to make phenotypically silent amino acid substitutions is provided in Bowie, J. U. et al., Science 247:1306–1310(1990), wherein the authors indicate that there are two main strategies for studying the tolerance of an amino acid sequence to change.

The first strategy exploits the tolerance of amino acid substitutions by natural selection during the process of evolution. By comparing amino acid sequences in different species, conserved amino acids can be identified. These conserved amino acids are likely important for protein function. In contrast, the amino acid positions where substitutions have been tolerated by natural selection indicates that these positions are not critical for protein function. Thus, positions tolerating amino acid substitution could be modified while still maintaining biological activity of the protein.

The second strategy uses genetic engineering to introduce amino acid changes at specific positions of a cloned gene to identify regions critical for protein function. For example, site directed mutagenesis or alanine-scanning mutagenesis (introduction of single alanine mutations at every residue in the molecule) can be used. (Cunningham and Wells, Science 244:1081–1085 (1989).) The resulting mutant molecules can then be tested for biological activity.

As the authors state, these two strategies have revealed that proteins are surprisingly tolerant of amino acid substitutions. The authors further indicate which amino acid changes are likely to be permissive at certain amino acid positions in the protein. For example, most buried (within the tertiary structure of the protein) amino acid residues require nonpolar side chains, whereas few features of surface side chains are generally conserved. Moreover, tolerated conservative amino acid substitutions involve replacement of the aliphatic or hydrophobic amino acids Ala, Val, Leu and Ile; replacement of the hydroxyl residues Ser and Thr; replacement of the acidic residues Asp and Glu; replacement of the amide residues Asn and Gln, replacement of the basic residues Lys, Arg, and His; replacement of the aromatic residues Phe, Tyr, and Trp, and replacement of the small-sized amino acids Ala, Ser, Thr, Met, and Gly.

Besides conservative amino acid substitution, variants of the present invention include (i) substitutions with one or more of the non-conserved amino acid residues, where the substituted amino acid residues may or may not be one encoded by the genetic code, or (ii) substitution with one or more of amino acid residues having a substituent group, or (iii) fusion of the mature polypeptide with another compound, such as a compound to increase the stability and/or solubility of the polypeptide (for example, polyethylene glycol), or (iv) fusion of the polypeptide with additional amino acids, such as an IgG Fc fusion region peptide, or leader or secretory sequence, or a sequence facilitating purification. Such variant polypeptides are deemed to be within the scope of those skilled in the art from the teachings herein.

For example, polypeptide variants containing amino acid substitutions of charged amino acids with other charged or neutral amino acids may produce proteins with improved characteristics, such as less aggregation. Aggregation of pharmaceutical formulations both reduces activity and increases clearance due to the aggregate's immunogenic activity. (Pinckard et al., Clin. Exp. Immunol. 2:331–340 (1967); Robbins et al., Diabetes 36: 838–845 (1987); Cleland et al., Crit. Rev. Therapeutic Drug Carrier Systems 10:307–377 (1993).)

Polynucleotide and Polypeptide Fragments

In the present invention, a "polynucleotide fragment" refers to a short polynucleotide having a nucleic acid sequence contained in the deposited clone or shown in SEQ ID NO:X. The short nucleotide fragments are preferably at least about 15 nt, and more preferably at least about 20 nt, still more preferably at least about 30 nt, and even more preferably, at least about 40 nt in length. A fragment "at least 20 nt in length," for example, is intended to include 20 or more contiguous bases from the cDNA sequence contained in the deposited clone or the nucleotide sequence shown in SEQ ID NO:X. These nucleotide fragments are useful as diagnostic probes and primers as discussed herein. Of course, larger fragments (e.g. 50, 150, 500, 600, 2000 nucleotides) are preferred.

Moreover, representative examples of polynucleotide fragments of the invention, include, for example, fragments having a sequence from about nucleotide number 1–50, 51–100, 101–150, 151–200, 201–250, 251–300, 301–350, 351–400, 401–450, 451–500, 501–550, 551–600, 651–700, 701–750, 751–800, 800–850, 851–900, 901–950, 951–1000, 1001–1050, 1051–1100, 1101–1150, 1151–1200, 1201–1250, 1251–1300, 1301–1350, 1351–1400, 1401–1450, 1451–1500, 1501–1550, 1551–1600, 1601–1650, 1651–1700, 1701–1750, 1751–1800, 1801–1850, 1851–1900, 1901–1950, 1951–2000, or 2001 to the end of SEQ ID NO:X or the cDNA contained in the deposited clone. In this context "about" includes the particularly recited ranges, larger or smaller by several (5, 4, 3, 2, or 1) nucleotides, at either terminus or at both termini. Preferably, these fragments encode a polypeptide which has biological activity. More preferably, these polynucleotides can be used as probes or primers as discussed herein.

In the present invention, a "polypeptide fragment" refers to a short amino acid sequence contained in SEQ ID NO:Y or encoded by the cDNA contained in the deposited clone. Protein fragments may be "free-standing," or comprised within a larger polypeptide of which the fragment forms a part or region, most preferably as a single continuous region. Representative examples of polypeptide fragments of the invention, include, for example, fragments from about amino acid number 1–20, 21–40, 41–60, 61–80, 81–100, 102–120, 121–140, 141–160, or 161 to the coding region. Moreover, polypeptide fragments can be about 20, 30, 40, 50, 60, 70, 80, 90, 100, 110, 120, 130, 140, or 150 amino acids in length. In this context "about" includes the particularly recited ranges, larger or smaller by several (5, 4, 3, 2, or 1) amino acids, at either extreme or at both extremes.

Preferred polypeptide fragments include the secreted protein as well as the mature form. Further preferred polypeptide fragments include the secreted protein or the mature form having a continuous series of deleted residues from the amino or the carboxy terminus, or both. For example, any number of amino acids, ranging from 1–60, can be deleted from the amino terminus of either the secreted polypeptide or the mature form. Similarly, any number of amino acids, ranging from 1–30, can be deleted from the carboxy terminus of the secreted protein or mature form. Furthermore, any combination of the above amino and carboxy terminus deletions are preferred. Similarly, polynucleotide fragments encoding these polypeptide fragments are also preferred.

Also preferred are polypeptide and polynucleotide fragments characterized by structural or functional domains, such as fragments that comprise alpha-helix and alpha-helix forming regions, beta-sheet and beta-sheet-forming regions, turn and turn-forming regions, coil and coil-forming regions, hydrophilic regions, hydrophobic regions, alpha amphipathic regions, beta amphipathic regions, flexible regions, surface-forming regions, substrate binding region, and high antigenic index regions. Polypeptide fragments of SEQ ID NO:Y falling within conserved domains are specifically contemplated by the present invention. Moreover, polynucleotide fragments encoding these domains are also contemplated.

Other preferred fragments are biologically active fragments. Biologically active fragments are those exhibiting activity similar, but not necessarily identical, to an activity of the polypeptide of the present invention. The biological activity of the fragments may include an improved desired activity, or a decreased undesirable activity.

Epitopes & Antibodies

In the present invention, "epitopes" refer to polypeptide fragments having antigenic or immunogenic activity in an animal, especially in a human. A preferred embodiment of the present invention relates to a polypeptide fragment comprising an epitope, as well as the polynucleotide encoding this fragment. A region of a protein molecule to which an antibody can bind is defined as an "antigenic epitope." In contrast, an "immunogenic epitope" is defined as a part of a protein that elicits an antibody response. (See, for instance, Geysen et al., Proc. Natl. Acad. Sci. USA 81:3998–4002 (1983).)

Fragments which function as epitopes may be produced by any conventional means. (See, e.g. Houghten, R. A., Proc. Natl. Acad. Sci. USA 82:5131–5135 (1985) further described in U.S. Pat. No. 4,631,211. )

In the present invention, antigenic epitopes preferably contain a sequence of at least seven, more preferably at least nine, and most preferably between about 15 to about 30 amino acids. Antigenic epitopes are useful to raise antibodies, including monoclonal antibodies, that specifically bind the epitope. (See, for instance, Wilson et al., Cell 37:767–778 (1984); Sutcliffe, J. G. et al., Science 219:660–666 (1983).)

Similarly, immunogenic epitopes can be used to induce antibodies according to methods well known in the art. (See, for instance, Sutcliffe et al., supra; Wilson et al., supra; Chow, M. et al., Proc. Natl. Acad. Sci. USA 82:910–914; and Bittle, F. J. et al., J. Gen. Virol. 66:2347–2354 (1985).) A preferred immunogenic epitope includes the secreted protein. The immunogenic epitopes may be presented together with a carrier protein, such as an albumin, to an animal system (such as rabbit or mouse) or, if it is long enough (at least about 25 amino acids), without a carrier. However, immunogenic epitopes comprising as few as 8 to 10 amino acids have been shown to be sufficient to raise antibodies capable of binding to, at the very least, linear epitopes in a denatured polypeptide (e.g. in Western blotting.)

As used herein, the term "antibody" (Ab) or "monoclonal antibody" (Mab) is meant to include intact molecules as well as antibody fragments (such as, for example, Fab and F(ab')2 fragments) which are capable of specifically binding to protein. Fab and F(ab')2 fragments lack the Fc fragment of intact antibody, clear more rapidly from the circulation, and may have less non-specific tissue binding than an intact antibody. (Wahl et al., J. Nucl. Med. 24:316–325 (1983).) Thus, these fragments are preferred, as well as the products of a FAB or other immunoglobulin expression library. Moreover, antibodies of the present invention include chimeric, single chain, and humanized antibodies.

Fusion Proteins

Any polypeptide of the present invention can be used to generate fusion proteins. For example, the polypeptide of the present invention, when fused to a second protein, can be used as an antigenic tag. Antibodies raised against the polypeptide of the present invention can be used to indirectly detect the second protein by binding to the polypeptide. Moreover, because secreted proteins target cellular locations based on trafficking signals, the polypeptides of the present invention can be used as targeting molecules once fused to other proteins.

Examples of domains that can be fused to polypeptides of the present invention include not only heterologous signal sequences, but also other heterologous functional regions. The fusion does not necessarily need to be direct, but may occur through linker sequences.

Moreover, fusion proteins may also be engineered to improve characteristics of the polypeptide of the present invention. For instance, a region of additional amino acids, particularly charged amino acids, may be added to the N-terminus of the polypeptide to improve stability and persistence during purification from the host cell or subsequent handling and storage. Also, peptide moieties may be added to the polypeptide to facilitate purification. Such regions may be removed prior to final preparation of the polypeptide. The addition of peptide moieties to facilitate handling of polypeptides are familiar and routine techniques in the art.

Moreover, polypeptides of the present invention, including fragments, and specifically epitopes, can be combined with parts of the constant domain of immunoglobulins (IgG), resulting in chimeric polypeptides. These fusion proteins facilitate purification and show an increased half-life in vivo. One reported example describes chimeric proteins consisting of the first two domains of the human CD4-polypeptide and various domains of the constant regions of the heavy or light chains of mammalian immunoglobulins. (EP A 394,827; Traunecker et al., Nature 331:84–86 (1988).) Fusion proteins having disulfide-linked dimeric structures (due to the IgG) can also be more efficient in binding and neutralizing other molecules, than the monomeric secreted protein or protein fragment alone. (Fountoulakis et al., J. Biochem. 270:3958–3964 (1995).) Similarly, EP-A-O 464 533 (Canadian counterpart 2045869) discloses fusion proteins comprising various portions of constant region of immunoglobulin molecules together with another human protein or part thereof. In many cases, the Fc part in a fusion protein is beneficial in therapy and diagnosis, and thus can result in, for example, improved pharnacokinetic properties. (EP-A 0232 262. ) Alternatively, deleting the Fc part after the fusion protein has been expressed, detected, and purified, would be desired. For example, the Fc portion may hinder therapy and diagnosis if the fusion protein is used as an antigen for immunizations. In drug discovery, for example, human proteins, such as hIL-5, have been fused with Fc portions for the purpose of high-throughput screening assays to identify antagonists of hIL-5. (See, D. Bennett et al., J. Molecular Recognition 8:52–58 (1995); K. Johanson et al., J. Biol. Chem. 270:9459–9471 (1995).)

Moreover, the polypeptides of the present invention can be fused to marker sequences, such as a peptide which facilitates purification of the fused polypeptide. In preferred embodiments, the marker amino acid sequence is a hexa-histidine peptide, such as the tag provided in a pQE vector (QIAGEN, Inc., 9259 Eton Avenue, Chatsworth, CA, 91311), among others, many of which are commercially available. As described in Gentz et al., Proc. Natl. Acad. Sci. USA 86:821–824 (1989), for instance, hexa-histidine provides for convenient purification of the fusion protein. Another peptide tag useful for purification, the "HA" tag, corresponds to an epitope derived from the influenza hemagglutinin protein. (Wilson et al., Cell 37:767 (1984).) Thus, any of these above fusions can be engineered using the polynucleotides or the polypeptides of the present invention.

Vectors. Host Cells, and Protein Production

The present invention also relates to vectors containing the polynucleotide of the present invention, host cells, and the production of polypeptides by recombinant techniques. The vector may be, for example, a phage, plasmid, viral, or retroviral vector. Retroviral vectors may be replication competent or replication defective. In the latter case, viral propagation generally will occur only in complementing host cells.

The polynucleotides may be joined to a vector containing a selectable marker for propagation in a host. Generally, a plasmid vector is introduced in a precipitate, such as a calcium phosphate precipitate, or in a complex with a charged lipid. If the vector is a virus, it may be packaged in vitro using an appropriate packaging cell line and then transduced into host cells.

The polynucleotide insert should be operatively linked to an appropriate promoter, such as the phage lambda PL promoter, the E. coli lac, trp, phoA and tac promoters, the SV40 early and late promoters and promoters of retroviral LTRs, to name a few. Other suitable promoters will be known to the skilled artisan. The expression constructs will further contain sites for transcription initiation, termination, and, in the transcribed region, a ribosome binding site for translation. The coding portion of the transcripts expressed by the constructs will preferably include a translation initiating codon at the beginning and a termination codon (UAA, UGA or UAG) appropriately positioned at the end of the polypeptide to be translated.

As indicated, the expression vectors will preferably include at least one selectable marker. Such markers include dihydrofolate reductase, G418 or neomycin resistance for eukaryotic cell culture and tetracycline, kanamycin or ampicillin resistance genes for culturing in E. coli and other bacteria. Representative examples of appropriate hosts include, but are not limited to, bacterial cells, such as E. coli, Streptomyces and Salmonella typhimurium cells; fungal cells, such as yeast cells; insect cells such as Drosophila S2 and Spodoptera Sf9 cells; animal cells such as CHO, COS, 293, and Bowes melanoma cells; and plant cells. Appropriate culture mediums and conditions for the above-described host cells are known in the art.

Among vectors preferred for use in bacteria include pQE70, pQE60 and pQE-9, available from QIAGEN, Inc.; pBluescript vectors, Phagescript vectors, pNH8A, pNH16a, pNH18A, pNH46A, available from Stratagene Cloning Systems, Inc.; and ptrc99a, pKK223-3, pKK233-3, pDR540, pRIT5 available from Pharmacia Biotech, Inc. Among preferred eukaryotic vectors are pWLNEO, pSV2CAT, pOG44, pXT1 and pSG available from Stratagene; and pSVK3, pBPV, pMSG and pSVL available from Pharmacia. Other suitable vectors will be readily apparent to the skilled artisan.

Introduction of the construct into the host cell can be effected by calcium phosphate transfection, DEAE-dextran mediated transfection, cationic lipid-mediated transfection, electroporation, transduction, infection, or other methods. Such methods are described in many standard laboratory manuals, such as Davis et al., Basic Methods In Molecular Biology (1986). It is specifically contemplated that the polypeptides of the present invention may in fact be expressed by a host cell lacking a recombinant vector.

A polypeptide of this invention can be recovered and purified from recombinant cell cultures by well-known methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Most preferably, high performance liquid chromatography ("HPLC") is employed for purification.

Polypeptides of the present invention, and preferably the secreted form, can also be recovered from: products purified from natural sources, including bodily fluids, tissues and cells, whether directly isolated or cultured; products of chemical synthetic procedures; and products produced by recombinant techniques from a prokaryotic or eukaryotic host, including, for example, bacterial, yeast, higher plant, insect, and mammalian cells. Depending upon the host employed in a recombinant production procedure, the polypeptides of the present invention may be glycosylated or may be non-glycosylated. In addition, polypeptides of the invention may also include an initial modified methionine residue, in some cases as a result of host-mediated processes. Thus, it is well known in the art that the N-terminal methionine encoded by the translation initiation codon generally is removed with high efficiency from any protein after translation in all eukaryotic cells. While the N-terminal methionine on most proteins also is efficiently removed in most prokaryotes, for some proteins, this prokaryotic removal process is inefficient, depending on the nature of the amino acid to which the N-terminal methionine is covalently linked.

Uses of the Polynucleotides

Each of the polynucleotides identified herein can be used in numerous ways as reagents. The following description should be considered exemplary and utilizes known techniques.

The polynucleotides of the present invention are useful for chromosome identification. There exists an ongoing need to identify new chromosome markers, since few chromosome marking reagents, based on actual sequence data (repeat polymorphisms), are presently available. Each polynucleotide of the present invention can be used as a chromosome marker.

Briefly, sequences can be mapped to chromosomes by preparing PCR primers (preferably 15–25 bp) from the sequences shown in SEQ ID NO:X. Primers can be selected using computer analysis so that primers do not span more than one predicted exon in the genomic DNA. These primers are then used for PCR screening of somatic cell hybrids containing individual human chromosomes. Only those hybrids containing the human gene corresponding to the SEQ ID NO:X will yield an amplified fragment.

Similarly, somatic hybrids provide a rapid method of PCR mapping the polynucleotides to particular chromosomes. Three or more clones can be assigned per day using a single thermal cycler. Moreover, sublocalization of the polynucleotides can be achieved with panels of specific chromosome fragments. Other gene mapping strategies that can be used include in situ hybridization, prescreening with labeled flow-sorted chromosomes, and preselection by hybridization to construct chromosome specific-cDNA libraries.

Precise chromosomal location of the polynucleotides can also be achieved using fluorescence in situ hybridization (FISH) of a metaphase chromosomal spread. This technique uses polynucleotides as short as 500 or 600 bases; however, polynucleotides 2,000–4,000 bp are preferred. For a review of this technique, see Verma et al., "Human Chromosomes: a Manual of Basic Techniques," Pergamon Press, New York (1988).

For chromosome mapping, the polynucleotides can be used individually (to mark a single chromosome or a single site on that chromosome) or in panels (for marking multiple sites and/or multiple chromosomes). Preferred polynucleotides correspond to the noncoding regions of the cDNAs because the coding sequences are more likely conserved within gene families, thus increasing the chance of cross hybridization during chromosomal mapping.

Once a polynucleotide has been mapped to a precise chromosomal location, the physical position of the polynucleotide can be used in linkage analysis. Linkage analysis establishes coinheritance between a chromosomal location and presentation of a particular disease. (Disease mapping data are found, for example, in V. McKusick, Mendelian Inheritance in Man (available on line through Johns Hopkins University Welch Medical Library).) Assuming 1 megabase mapping resolution and one gene per 20 kb, a cDNA precisely localized to a chromosomal region associated with the disease could be one of 50–500 potential causative genes.

Thus, once coinheritance is established, differences in the polynucleotide and the corresponding gene between affected and unaffected individuals can be examined. First, visible structural alterations in the chromosomes, such as deletions or translocations, are examined in chromosome spreads or by PCR. If no structural alterations exist, the presence of point mutations are ascertained. Mutations observed in some or all affected individuals, but not in normal individuals, indicates that the mutation may cause the disease. However, complete sequencing of the polypeptide and the corresponding gene from several normal individuals is required to distinguish the mutation from a polymorphism. If a new polymorphism is identified, this polymorphic polypeptide can be used for further linkage analysis.

Furthermore, increased or decreased expression of the gene in affected individuals as compared to unaffected individuals can be assessed using polynucleotides of the present invention. Any of these alterations (altered expression, chromosomal rearrangement, or mutation) can be used as a diagnostic or prognostic marker.

In addition to the foregoing, a polynucleotide can be used to control gene expression through triple helix formation or antisense DNA or RNA. Both methods rely on binding of the polynucleotide to DNA or RNA. For these techniques, preferred polynucleotides are usually 20 to 40 bases in length and complementary to either the region of the gene involved in transcription (triple helix—see Lee et al., Nucl. Acids Res. 6:3073 (1979); Cooney et al., Science 241:456 (1988); and Dervan et al., Science 251:1360 (1991) ) or to the mRNA itself (antisense—Okano, J. Neurochem. 56:560 (1991); Oligodeoxy-nucleotides as Antisense Inhibitors of Gene Expression, CRC Press, Boca Raton, Fla. (1988).) Triple helix formation optimally results in a shut-off of RNA transcription from DNA, while antisense RNA hybridization blocks translation of an mRNA molecule into polypeptide. Both techniques are effective in model systems, and the information disclosed herein can be used to design antisense or triple helix polynucleotides in an effort to treat disease.

Polynucleotides of the present invention are also useful in gene therapy. One goal of gene therapy is to insert a normal gene into an organism having a defective gene, in an effort to correct the genetic defect. The polynucleotides disclosed in the present invention offer a means of targeting such genetic defects in a highly accurate manner. Another goal is to insert a new gene that was not present in the host genome, thereby producing a new trait in the host cell.

The polynucleotides are also useful for identifying individuals from minute biological samples. The United States military, for example, is considering the use of restriction fragment length polymorphism (RFLP) for identification of its personnel. In this technique, an individual's genomic DNA is digested with one or more restriction enzymes, and probed on a Southern blot to yield unique bands for identifying personnel. This method does not suffer from the current limitations of "Dog Tags" which can be lost, switched, or stolen, making positive identification difficult. The polynucleotides of the present invention can be used as additional DNA markers for RFLP.

The polynucleotides of the present invention can also be used as an alternative to RFLP, by determining the actual base-by-base DNA sequence of selected portions of an individual's genome. These sequences can be used to prepare PCR primers for amplifying and isolating such selected DNA, which can then be sequenced. Using this technique, individuals can be identified because each individual will have a unique set of DNA sequences. Once an unique ID database is established for an individual, positive identification of that individual, living or dead, can be made from extremely small tissue samples.

Forensic biology also benefits from using DNA-based identification techniques as disclosed herein. DNA sequences taken from very small biological samples such as tissues, e.g. hair or skin, or body fluids, e.g. blood, saliva, semen, etc., can be amplified using PCR. In one prior art technique, gene sequences amplified from polymorphic loci, such as DQa class II HLA gene, are used in forensic biology to identify individuals. (Erlich, H., PCR Technology, Freeman and Co. (1992).) Once these specific polymorphic loci are amplified, they are digested with one or more restriction enzymes, yielding an identifying set of bands on a Southern blot probed with DNA corresponding to the DQa class II HLA gene. Similarly, polynucleotides of the present invention can be used as polymorphic markers for forensic purposes.

There is also a need for reagents capable of identifying the source of a particular tissue. Such need arises, for example, in forensics when presented with tissue of unknown origin. Appropriate reagents can comprise, for example, DNA probes or primers specific to particular tissue prepared from the sequences of the present invention. Panels of such reagents can identify tissue by species and/or by organ type. In a similar fashion, these reagents can be used to screen tissue cultures for contamination.

In the very least, the polynucleotides of the present invention can be used as molecular weight markers on Southern gels, as diagnostic probes for the presence of a specific mRNA in a particular cell type, as a probe to "subtract-out" known sequences in the process of discovering novel polynucleotides, for selecting and making oligomers for attachment to a "gene chip" or other support, to raise anti-DNA antibodies using DNA immunization techniques, and as an antigen to elicit an immune response.

Uses of the Polypeptides

Each of the polypeptides identified herein can be used in numerous ways. The following description should be considered exemplary and utilizes known techniques.

A polypeptide of the present invention can be used to assay protein levels in a biological sample using antibody-based techniques. For example, protein expression in tissues can be studied with classical immunohistological methods. (Jalkanen, M., et al., J. Cell. Biol. 101:976–985 (1985); Jalkanen, M., et al., J. Cell . Biol. 105:3087–3096 (1987).) Other antibody-based methods useful for detecting protein gene expression include immunoassays, such as the enzyme linked immunosorbent assay (ELISA) and the radioimmunoassay (RIA). Suitable antibody assay labels are known in the art and include enzyme labels, such as, glucose oxidase, and radioisotopes, such as iodine (125I, 121I), carbon (14C), sulfur (35S), tritium (3H), indium (112In), and technetium (99mTc), and fluorescent labels, such as fluorescein and rhodamine, and biotin.

In addition to assaying secreted protein levels in a biological sample, proteins can also be detected in vivo by imaging. Antibody labels or markers for in vivo imaging of protein include those detectable by X-radiography, NMR or ESR. For X-radiography, suitable labels include radioisotopes such as barium or cesium, which emit detectable radiation but are not overtly harmful to the subject. Suitable markers for NMR and ESR include those with a detectable characteristic spin, such as deuterium, which may be incorporated into the antibody by labeling of nutrients for the relevant hybridoma.

A protein-specific antibody or antibody fragment which has been labeled with an appropriate detectable imaging moiety, such as a radioisotope (for example, 131I, 112In, 99mTc), a radio-opaque substance, or a material detectable by nuclear magnetic resonance, is introduced (for example, parenterally, subcutaneously, or intraperitoneally) into the mammal. It will be understood in the art that the size of the subject and the imaging system used will determine the quantity of imaging moiety needed to produce diagnostic images. In the case of a radioisotope moiety, for a human subject, the quantity of radioactivity injected will normally range from about 5 to 20 millicuries of 99mTc. The labeled antibody or antibody fragment will then preferentially accumulate at the location of cells which contain the specific protein. In vivo tumor imaging is described in S. W. Burchiel et al., "Immunopharmacokinetics of Radiolabeled Antibodies and Their Fragments." (Chapter 13 in Tumor Imaging: The Radiochemical Detection of Cancer, S. W. Burchiel and B. A. Rhodes, eds., Masson Publishing Inc. (1982).)

Thus, the invention provides a diagnostic method of a disorder, which involves (a) assaying the expression of a polypeptide of the present invention in cells or body fluid of an individual; (b) comparing the level of gene expression with a standard gene expression level, whereby an increase or decrease in the assayed polypeptide gene expression level compared to the standard expression level is indicative of a disorder.

Moreover, polypeptides of the present invention can be used to treat disease. For example, patients can be administered a polypeptide of the present invention in an effort to replace absent or decreased levels of the polypeptide (e.g. insulin), to supplement absent or decreased levels of a different polypeptide (e.g. hemoglobin S for hemoglobin B), to inhibit the activity of a polypeptide (e.g. an oncogene), to activate the activity of a polypeptide (e.g. by binding to a receptor), to reduce the activity of a membrane bound receptor by competing with it for free ligand (e.g. soluble TNF receptors used in reducing inflammation), or to bring about a desired response (e.g. blood vessel growth).

Similarly, antibodies directed to a polypeptide of the present invention can also be used to treat disease. For example, administration of an antibody directed to a polypeptide of the present invention can bind and reduce overproduction of the polypeptide. Similarly, administration of an antibody can activate the polypeptide, such as by binding to a polypeptide bound to a membrane (receptor).

At the very least, the polypeptides of the present invention can be used as molecular weight markers on SDS-PAGE gels or on molecular sieve gel filtration columns using methods well known to those of skill in the art. Polypeptides can also be used to raise antibodies, which in turn are used to measure protein expression from a recombinant cell, as a way of assessing transformation of the host cell. Moreover, the polypeptides of the present invention can be used to test the following biological activities.

Biological Activities

The polynucleotides and polypeptides of the present invention can be used in assays to test for one or more biological activities. If these polynucleotides and polypeptides do exhibit activity in a particular assay, it is likely that these molecules may be involved in the diseases associated with the biological activity. Thus, the polynucleotides and polypeptides could be used to treat the associated disease.

Immune Activity

A polypeptide or polynucleotide of the present invention may be useful in treating deficiencies or disorders of the immune system, by activating or inhibiting the proliferation, differentiation, or mobilization (chemotaxis) of immune cells. Immune cells develop through a process called hematopoiesis, producing myeloid (platelets, red blood cells, neutrophils, and macrophages) and lymphoid (B and T lymphocytes) cells from pluripotent stem cells. The etiology of these immune deficiencies or disorders may be genetic, somatic, such as cancer or some autoimmune disorders, acquired (e.g. by chemotherapy or toxins), or infectious. Moreover, a polynucleotide or polypeptide of the present invention can be used as a marker or detector of a particular immune system disease or disorder.

A polynucleotide or polypeptide of the present invention may be useful in treating or detecting deficiencies or disorders of hematopoietic cells. A polypeptide or polynucleotide of the present invention could be used to increase differentiation and proliferation of hematopoietic cells, including the pluripotent stem cells, in an effort to treat those disorders associated with a decrease in certain (or many) types hematopoietic cells. Examples of immunologic deficiency syndromes include, but are not limited to: blood protein disorders (e.g. agammaglobulinemia, dysgammaglobulinemia), ataxia telangiectasia, common variable immunodeficiency, Digeorge Syndrome, HIV infection, HTLV-BLV infection, leukocyte adhesion deficiency syndrome, lymphopenia, phagocyte bactericidal dysfunction, severe combined immunodeficiency (SCIDs), Wiskott-Aldrich Disorder, anemia, thrombocytopenia, or hemoglobinuria.

Moreover, a polypeptide or polynucleotide of the present invention could also be used to modulate hemostatic (the stopping of bleeding) or thrombolytic activity (clot formation). For example, by increasing hemostatic or thrombolytic activity, a polynucleotide or polypeptide of the present invention could be used to treat blood coagulation disorders (e.g. afibrinogenemia, factor deficiencies), blood platelet disorders (e.g. thrombocytopenia), or wounds resulting from trauma, surgery, or other causes. Alternatively, a polynucleotide or polypeptide of the present invention that can decrease hemostatic or thrombolytic activity could be used to inhibit or dissolve clotting. These molecules could be important in the treatment of heart attacks (infarction), strokes, or scarring.

A polynucleotide or polypeptide of the present invention may also be useful in treating or detecting autoimmune disorders. Many autoimmune disorders result from inappropriate recognition of self as foreign material by immune cells. This inappropriate recognition results in an immune response leading to the destruction of the host tissue. Therefore, the administration of a polypeptide or polynucleotide of the present invention that inhibits an immune response, particularly the proliferation, differentiation, or chemotaxis of T-cells, may be an effective therapy in preventing autoimmune disorders.

Examples of autoimmune disorders that can be treated or detected by the present invention include, but are not limited to: Addison's Disease, hemolytic anemia, antiphospholipid syndrome, rheumatoid arthritis, dermatitis, allergic encephalomyelitis, glomerulonephritis, Goodpasture's Syndrome, Graves' Disease, Multiple Sclerosis, Myasthenia Gravis, Neuritis, Ophthalmia, Bullous Pemphigoid, Pemphigus, Polyendocrinopathies, Purpura, Reiter's Disease, Stiff-Man Syndrome, Autoimmune Thyroiditis, Systemic Lupus Erythematosus, Autoimmune Pulmonary Inflammation, Guillain-Barre Syndrome, insulin dependent diabetes mellitis, and autoimmune inflammatory eye disease.

Similarly, allergic reactions and conditions, such as asthma (particularly allergic asthma) or other respiratory problems, may also be treated by a polypeptide or polynucleotide of the present invention. Moreover, these molecules can be used to treat anaphylaxis, hypersensitivity to an antigenic molecule, or blood group incompatibility.

A polynucleotide or polypeptide of the present invention may also be used to treat and/or prevent organ rejection or graft-versus-host disease (GVHD). Organ rejection occurs by host immune cell destruction of the transplanted tissue through an immune response. Similarly, an immune response is also involved in GVHD, but, in this case, the foreign transplanted immune cells destroy the host tissues. The administration of a polypeptide or polynucleotide of the present invention that inhibits an immune response, particularly the proliferation, differentiation, or chemotaxis of T-cells, may be an effective therapy in preventing organ rejection or GVHD.

Similarly, a polypeptide or polynucleotide of the present invention may also be used to modulate inflammation. For example, the polypeptide or polynucleotide may inhibit the proliferation and differentiation of cells involved in an inflammatory response. These molecules can be used to treat inflammatory conditions, both chronic and acute conditions, including inflammation associated with infection (e.g. septic shock, sepsis, or systemic inflammatory response syndrome (SIRS)), ischemia-reperfusion injury, endotoxin lethality, arthritis, complement-mediated hyperacute rejection, nephritis, cytokine or chemokine induced lung injury, inflammatory bowel disease, Crohn's disease, or resulting from over production of cytokines (e.g. TNF or IL-1.)

Hyperproliferative Disorders

A polypeptide or polynucleotide can be used to treat or detect hyperproliferative disorders, including neoplasms. A polypeptide or polynucleotide of the present invention may inhibit the proliferation of the disorder through direct or indirect interactions. Alternatively, a polypeptide or polynucleotide of the present invention may proliferate other cells which can inhibit the hyperproliferative disorder.

For example, by increasing an immune response, particularly increasing antigenic qualities of the hyperproliferative disorder or by proliferating, differentiating, or mobilizing T-cells, hyperproliferative disorders can be treated. This immune response may be increased by either enhancing an existing immune response, or by initiating a new immune response. Alternatively, decreasing an immune response may also be a method of treating hyperproliferative disorders, such as a chemotherapeutic agent.

Examples of hyperproliferative disorders that can be treated or detected by a polynucleotide or polypeptide of the present invention include, but are not limited to neoplasms located in the: abdomen, bone, breast, digestive system, liver, pancreas, peritoneum, endocrine glands (adrenal, parathyroid, pituitary, testicles, ovary, thymus, thyroid), eye, head and neck, nervous (central and peripheral), lymphatic system, pelvic, skin, soft tissue, spleen, thoracic, and urogenital.

Similarly, other hyperproliferative disorders can also be treated or detected by a polynucleotide or polypeptide of the present invention. Examples of such hyperproliferative disorders include, but are not limited to: hypergammaglobulinemia, lymphoproliferative disorders, paraproteinemias, purpura, sarcoidosis, Sezary Syndrome, Waldenstron's Macroglobulinemia, Gaucher's Disease, histiocytosis, and any other hyperproliferative disease, besides neoplasia, located in an organ system listed above.

Infectious Disease

A polypeptide or polynucleotide of the present invention can be used to treat or detect infectious agents. For example, by increasing the immune response, particularly increasing the proliferation and differentiation of B and/or T cells, infectious diseases may be treated. The immune response may be increased by either enhancing an existing immune response, or by initiating a new immune response. Alternatively, the polypeptide or polynucleotide of the present invention may also directly inhibit the infectious agent, without necessarily eliciting an immune response.

Viruses are one example of an infectious agent that can cause disease or symptoms that can be treated or detected by a polynucleotide or polypeptide of the present invention. Examples of viruses, include, but are not limited to the following DNA and RNA viral families: Arbovirus, Adenoviridae, Arenaviridae, Arterivirus, Birnaviridae, Bunyaviridae, Caliciviridae, Circoviridae, Coronaviridae, Flaviviridae, Hepadnaviridae (Hepatitis), Herpesviridae (such as, Cytomegalovirus, Herpes Simplex, Herpes Zoster), Mononegavirus (e.g. Paramyxoviridae, Morbillivirus, Rhabdoviridae), Orthomyxoviridae (e.g. Influenza), Papovaviridae, Parvoviridae, Picornaviridae, Poxviridae (such as Smallpox or Vaccinia), Reoviridae (e.g. Rotavirus), Retroviridae (HTLV-I, HTLV-II, Lentivirus), and Togaviridae (e.g. Rubivirus). Viruses falling within these families can cause a variety of diseases or symptoms, including, but not limited to: arthritis, bronchiollitis, encephalitis, eye infections (e.g. conjunctivitis, keratitis), chronic fatigue syndrome, hepatitis (A, B, C, E, Chronic Active, Delta), meningitis, opportunistic infections (e.g. AIDS), pneumonia, Burkitt's Lymphoma, chickenpox, hemorrhagic fever, Measles, Mumps, Parainfluenza, Rabies, the common cold, Polio, leukemia, Rubella, sexually transmitted diseases, skin diseases (e.g. Kaposi's, warts), and viremia. A polypeptide or polynucleotide of the present invention can be used to treat or detect any of these symptoms or diseases.

Similarly, bacterial or fungal agents that can cause disease or symptoms and that can be treated or detected by a polynucleotide or polypeptide of the present invention include, but not limited to, the following Gram-Negative and Gram-positive bacterial families and fungi: Actinomycetales (e.g. Corynebacterium, Mycobacterium, Norcardia), Aspergillosis, Bacillaceae (e.g. Anthrax, Clostridium), Bacteroidaceae, Blastomycosis, Bordetella, Borrelia, Brucellosis, Candidiasis, Campylobacter, Coccidioidomycosis, Cryptococcosis, Dermatocycoses, Enterobacteriaceae (Klebsiella, Salmonella, Serratia, Yersinia), Erysipelothrix, Helicobacter, Legionellosis, Leptospirosis, Listeria, Mycoplasmatales, Neisseriaceae (e.g. Acinetobacter, Gonorrhea, Menigococcal), Pasteurellacea Infections (e.g. Actinobacillus, Heamophilus, Pasteurella), Pseudomonas, Rickettsiaceae, Chlamydiaceae, Syphilis, and Staphylococcal. These bacterial or fungal families can cause the following diseases or symptoms, including, but not limited to: bacteremia, endocarditis, eye infections (conjunctivitis, tuberculosis, uveitis), gingivitis, opportunistic infections (e.g. AIDS related infections), paronychia, prosthesis-related infections, Reiter's Disease, respiratory tract infections, such as Whooping Cough or Empyema, sepsis, Lyme Disease, Cat-Scratch Disease, Dysentery, Paratyphoid Fever, food poisoning, Typhoid, pneumonia, Gonorrhea, meningitis, Chlamydia, Syphilis, Diphtheria, Leprosy, Paratuberculosis, Tuberculosis, Lupus, Botulism, gangrene, tetanus, impetigo, Rheumatic Fever, Scarlet Fever, sexually transmitted diseases, skin diseases (e.g. cellulitis, dermatocycoses), toxemia, urinary tract infections, wound infections. A polypeptide or polynucleotide of the present invention can be used to treat or detect any of these symptoms or diseases.

Moreover, parasitic agents causing disease or symptoms that can be treated or detected by a polynucleotide or polypeptide of the present invention include, but not limited to, the following families: Amebiasis, Babesiosis, Coccidiosis, Cryptosporidiosis, Dientamoebiasis, Dourine, Ectoparasitic, Giardiasis, Helminthiasis, Leishmaniasis, Theileriasis, Toxoplasmosis, Trypanosomiasis, and Trichomonas. These parasites can cause a variety of diseases or symptoms, including, but not limited to: Scabies, Trombiculiasis, eye infections, intestinal disease (e.g. dysentery, giardiasis), liver disease, lung disease, opportunistic infections (e.g. AIDS related), Malaria, pregnancy complications, and toxoplasmosis. A polypeptide or polynucleotide of the present invention can be used to treat or detect any of these symptoms or diseases.

Preferably, treatment using a polypeptide or polynucleotide of the present invention could either be by administering an effective amount of a polypeptide to the patient, or by removing cells from the patient, supplying the cells with a polynucleotide of the present invention, and returning the engineered cells to the patient (ex vivo therapy). Moreover, the polypeptide or polynucleotide of the present invention can be used as an antigen in a vaccine to raise an immune response against infectious disease.

Regeneration

A polynucleotide or polypeptide of the present invention can be used to differentiate, proliferate, and attract cells, leading to the regeneration of tissues. (See, Science 276:59–87 (1997).) The regeneration of tissues could be used to repair, replace, or protect tissue damaged by congenital defects, trauma (wounds, burns, incisions, or ulcers), age, disease (e.g. osteoporosis, osteocarthritis, periodontal disease, liver failure), surgery, including cosmetic plastic surgery, fibrosis, reperfusion injury, or systemic cytokine damage.

Tissues that could be regenerated using the present invention include organs (e.g. pancreas, liver, intestine, kidney, skin, endothelium), muscle (smooth, skeletal or cardiac), vascular (including vascular endothelium), nervous, hematopoietic, and skeletal (bone, cartilage, tendon, and ligament) tissue. Preferably, regeneration occurs without or decreased scarring. Regeneration also may include angiogenesis.

Moreover, a polynucleotide or polypeptide of the present invention may increase regeneration of tissues difficult to heal. For example, increased tendon/ligament regeneration would quicken recovery time after damage. A polynucleotide or polypeptide of the present invention could also be used prophylactically in an effort to avoid damage. Specific diseases that could be treated include of tendinitis, carpal tunnel syndrome, and other tendon or ligament defects. A further example of tissue regeneration of non-healing wounds includes pressure ulcers, ulcers associated with vascular insufficiency, surgical, and traumatic wounds.

Similarly, nerve and brain tissue could also be regenerated by using a polynucleotide or polypeptide of the present invention to proliferate and differentiate nerve cells. Diseases that could be treated using this method include central and peripheral nervous system diseases, neuropathies, or mechanical and traumatic disorders (e.g. spinal cord disorders, head trauma, cerebrovascular disease, and stoke). Specifically, diseases associated with peripheral nerve injuries, peripheral neuropathy (e.g. resulting from chemotherapy or other medical therapies), localized neuropathies, and central nervous system diseases (e.g. Alzheimer's disease, Parkinson's disease, Huntington's disease, amyotrophic lateral sclerosis, and Shy-Drager syndrome), could all be treated using the polynucleotide or polypeptide of the present invention.

Chemotaxis

A polynucleotide or polypeptide of the present invention may have chemotaxis activity. A chemotaxic molecule attracts or mobilizes cells (e.g. monocytes, fibroblasts, neutrophils, T-cells, mast cells, eosinophils, epithelial and/or endothelial cells) to a particular site in the body, such as inflammation, infection, or site of hyperproliferation. The mobilized cells can then fight off and/or heal the particular trauma or abnormality.

A polynucleotide or polypeptide of the present invention may increase chemotaxic activity of particular cells. These chemotactic molecules can then be used to treat inflammation, infection, hyperproliferative disorders, or any immune system disorder by increasing the number of cells targeted to a particular location in the body. For example, chemotaxic molecules can be used to treat wounds and other trauma to tissues by attracting immune cells to the injured location. Chemotactic molecules of the present invention can also attract fibroblasts, which can be used to treat wounds.

It is also contemplated that a polynucleotide or polypeptide of the present invention may inhibit chemotactic activity. These molecules could also be used to treat disorders. Thus, a polynucleotide or polypeptide of the present invention could be used as an inhibitor of chemotaxis.

Binding Activity

A polypeptide of the present invention may be used to screen for molecules that bind to the polypeptide or for molecules to which the polypeptide binds. The binding of the polypeptide and the molecule may activate (agonist), increase, inhibit (antagonist), or decrease activity of the polypeptide or the molecule bound. Examples of such molecules include antibodies, oligonucleotides, proteins (e.g. receptors),or small molecules.

Preferably, the molecule is closely related to the natural ligand of the polypeptide, e.g. a fragment of the ligand, or a natural substrate, a ligand, a structural or functional mimetic. (See, Coligan et al., Current Protocols in Immunology 1(2):Chapter 5 (1991).) Similarly, the molecule can be closely related to the natural receptor to which the polypeptide binds, or at least, a fragment of the receptor capable of being bound by the polypeptide (e.g. active site). In either case, the molecule can be rationally designed using known techniques.

Preferably, the screening for these molecules involves producing appropriate cells which express the polypeptide, either as a secreted protein or on the cell membrane. Preferred cells include cells from mammals, yeast, Drosophila, or E. coli. Cells expressing the polypeptide (or cell membrane containing the expressed polypeptide) are then preferably contacted with a test compound potentially containing the molecule to observe binding, stimulation, or inhibition of activity of either the polypeptide or the molecule.

The assay may simply test binding of a candidate compound to the polypeptide, wherein binding is detected by a label, or in an assay involving competition with a labeled competitor. Further, the assay may test whether the candidate compound results in a signal generated by binding to the polypeptide.

Alternatively, the assay can be carried out using cell-free preparations, polypeptide/molecule affixed to a solid support, chemical libraries, or natural product mixtures. The assay may also simply comprise the steps of mixing a candidate compound with a solution containing a polypeptide, measuring polypeptide/molecule activity or binding, and comparing the polypeptide/molecule activity or binding to a standard.

Preferably, an ELISA assay can measure polypeptide level or activity in a sample (e.g. biological sample) using a monoclonal or polyclonal antibody. The antibody can measure polypeptide level or activity by either binding, directly or indirectly, to the polypeptide or by competing with the polypeptide for a substrate.

All of these above assays can be used as diagnostic or prognostic markers. The molecules discovered using these assays can be used to treat disease or to bring about a particular result in a patient (e.g. blood vessel growth) by activating or inhibiting the polypeptide/molecule. Moreover, the assays can discover agents which may inhibit or enhance the production of the polypeptide from suitably manipulated cells or tissues.

Therefore, the invention includes a method of identifying compounds which bind to a polypeptide of the invention comprising the steps of: (a) incubating a candidate binding compound with a polypeptide of the invention; and (b) determining if binding has occurred. Moreover, the invention includes a method of identifying agonists/antagonists comprising the steps of: (a) incubating a candidate compound with a polypeptide of the invention, (b) assaying a biological activity, and (b) determining if a biological activity of the polypeptide has been altered.

Other Activities

A polypeptide or polynucleotide of the present invention may also increase or decrease the differentiation or proliferation of embryonic stem cells, besides, as discussed above, hematopoietic lineage.

A polypeptide or polynucleotide of the present invention may also be used to modulate mammalian characteristics, such as body height, weight, hair color, eye color, skin, percentage of adipose tissue, pigmentation, size, and shape (e.g. cosmetic surgery). Similarly, a polypeptide or polynucleotide of the present invention may be used to modulate mammalian metabolism affecting catabolism, anabolism, processing, utilization, and storage of energy.

A polypeptide or polynucleotide of the present invention may be used to change a mammal's mental state or physical state by influencing biorhythms, caricadic rhythms, depression (including depressive disorders), tendency for violence, tolerance for pain, reproductive capabilities (preferably by Activin or Inhibin-like activity), hormonal or endocrine levels, appetite, libido, memory, stress, or other cognitive qualities.

A polypeptide or polynucleotide of the present invention may also be used as a food additive or preservative, such as to increase or decrease storage capabilities, fat content, lipid, protein, carbohydrate, vitamins, minerals, cofactors or other nutritional components.

Other Preferred Embodiments

Other preferred embodiments of the claimed invention include an isolated nucleic acid molecule comprising a nucleotide sequence which is at least 95% identical to a sequence of at least about 50 contiguous nucleotides in the nucleotide sequence of SEQ ID NO:X wherein X is any integer as defined in Table 1.

Also preferred is a nucleic acid molecule wherein said sequence of contiguous nucleotides is included in the nucleotide sequence of SEQ ID NO:X in the range of positions beginning with the nucleotide at about the position of the 5' Nucleotide of the Clone Sequence and ending with the nucleotide at about the position of the 3' Nucleotide of the Clone Sequence as defined for SEQ ID NO:X in Table 1.

Also preferred is a nucleic acid molecule wherein said sequence of contiguous nucleotides is included in the nucleotide sequence of SEQ ID NO:X in the range of positions beginning with the nucleotide at about the position of the 5' Nucleotide of the Start Codon and ending with the nucleotide at about the position of the 3' Nucleotide of the Clone Sequence as defined for SEQ ID NO:X in Table 1.

Similarly preferred is a nucleic acid molecule wherein said sequence of contiguous nucleotides is included in the nucleotide sequence of SEQ ID NO:X in the range of positions beginning with the nucleotide at about the position of the 5' Nucleotide of the First Amino Acid of the Signal Peptide and ending with the nucleotide at about the position of the 3' Nucleotide of the Clone Sequence as defined for SEQ ID NO:X in Table 1.

Also preferred is an isolated nucleic acid molecule comprising a nucleotide sequence which is at least 95% identical to a sequence of at least about 150 contiguous nucleotides in the nucleotide sequence of SEQ ID NO:X.

Further preferred is an isolated nucleic acid molecule comprising a nucleotide sequence which is at least 95% identical to a sequence of at least about 500 contiguous nucleotides in the nucleotide sequence of SEQ ID NO:X.

A further preferred embodiment is a nucleic acid molecule comprising a nucleotide sequence which is at least 95% identical to the nucleotide sequence of SEQ ID NO:X beginning with the nucleotide at about the position of the 5' Nucleotide of the First Amino Acid of the Signal Peptide and ending with the nucleotide at about the position of the 3' Nucleotide of the Clone Sequence as defined for SEQ ID NO:X in Table 1.

A further preferred embodiment is an isolated nucleic acid molecule comprising a nucleotide sequence which is at least 95% identical to the complete nucleotide sequence of SEQ ID NO:X.

Also preferred is an isolated nucleic acid molecule which hybridizes under stringent hybridization conditions to a nucleic acid molecule, wherein said nucleic acid molecule which hybridizes does not hybridize under stringent hybridization conditions to a nucleic acid molecule having a nucleotide sequence consisting of only A residues or of only T residues.

Also preferred is a composition of matter comprising a DNA molecule which comprises a human cDNA clone identified by a cDNA Clone Identifier in Table 1, which DNA molecule is contained in the material deposited with the American Type Culture Collection and given the ATCC Deposit Number shown in Table 1 for said cDNA Clone Identifier.

Also preferred is an isolated nucleic acid molecule comprising a nucleotide sequence which is at least 95% identical to a sequence of at least 50 contiguous nucleotides in the nucleotide sequence of a human cDNA clone identified by a cDNA Clone Identifier in Table 1, which DNA molecule is contained in the deposit given the ATCC Deposit Number shown in Table 1.

Also preferred is an isolated nucleic acid molecule, wherein said sequence of at least 50 contiguous nucleotides is included in the nucleotide sequence of the complete open reading frame sequence encoded by said human cDNA clone.

Also preferred is an isolated nucleic acid molecule comprising a nucleotide sequence which is at least 95% identical to sequence of at least 150 contiguous nucleotides in the nucleotide sequence encoded by said human cDNA clone.

A further preferred embodiment is an isolated nucleic acid molecule comprising a nucleotide sequence which is at least 95% identical to sequence of at least 500 contiguous nucleotides in the nucleotide sequence encoded by said human cDNA clone.

A further preferred embodiment is an isolated nucleic acid molecule comprising a nucleotide sequence which is at least 95% identical to the complete nucleotide sequence encoded by said human cDNA clone.

A further preferred embodiment is a method for detecting in a biological sample a nucleic acid molecule comprising a nucleotide sequence which is at least 95% identical to a sequence of at least 50 contiguous nucleotides in a sequence selected from the group consisting of: a nucleotide sequence of SEQ ID NO:X wherein X is any integer as defined in Table 1; and a nucleotide sequence encoded by a human cDNA clone identified by a cDNA Clone Identifier in Table 1 and contained in the deposit with the ATCC Deposit Number shown for said cDNA clone in Table 1; which method comprises a step of comparing a nucleotide sequence of at least one nucleic acid molecule in said sample with a sequence selected from said group and determining whether the sequence of said nucleic acid molecule in said sample is at least 95% identical to said selected sequence.

Also preferred is the above method wherein said step of comparing sequences comprises determining the extent of nucleic acid hybridization between nucleic acid molecules in said sample and a nucleic acid molecule comprising said sequence selected from said group. Similarly, also preferred is the above method wherein said step of comparing sequences is performed by comparing the nucleotide sequence determined from a nucleic acid molecule in said sample with said sequence selected from said group. The nucleic acid molecules can comprise DNA molecules or RNA molecules.

A further preferred embodiment is a method for identifying the species, tissue or cell type of a biological sample which method comprises a step of detecting nucleic acid molecules in said sample, if any, comprising a nucleotide sequence that is at least 95% identical to a sequence of at least 50 contiguous nucleotides in a sequence selected from the group consisting of: a nucleotide sequence of SEQ ID NO:X wherein X is any integer as defined in Table 1; and a nucleotide sequence encoded by a human cDNA clone identified by a cDNA Clone Identifier in Table 1 and contained in the deposit with the ATCC Deposit Number shown for said cDNA clone in Table 1.

The method for identifying the species, tissue or cell type of a biological sample can comprise a step of detecting nucleic acid molecules comprising a nucleotide sequence in a panel of at least two nucleotide sequences, wherein at least one sequence in said panel is at least 95% identical to a sequence of at least 50 contiguous nucleotides in a sequence selected from said group.

Also preferred is a method for diagnosing in a subject a pathological condition associated with abnormal structure or expression of a gene encoding a secreted protein identified in Table 1, which method comprises a step of detecting in a biological sample obtained from said subject nucleic acid molecules, if any, comprising a nucleotide sequence that is at least 95% identical to a sequence of at least 50 contiguous nucleotides in a sequence selected from the group consisting of: a nucleotide sequence of SEQ ID NO:X wherein X is any integer as defined in Table 1; and a nucleotide sequence encoded by a human cDNA clone identified by a cDNA Clone Identifier in Table 1 and contained in the deposit with the ATCC Deposit Number shown for said cDNA clone in Table 1.

The method for diagnosing a pathological condition can comprise a step of detecting nucleic acid molecules comprising a nucleotide sequence in a panel of at least two nucleotide sequences, wherein at least one sequence in said panel is at least 95% identical to a sequence of at least 50 contiguous nucleotides in a sequence selected from said group.

Also preferred is a composition of matter comprising isolated nucleic acid molecules wherein the nucleotide sequences of said nucleic acid molecules comprise a panel of at least two nucleotide sequences, wherein at least one sequence in said panel is at least 95% identical to a sequence of at least 50 contiguous nucleotides in a sequence selected from the group consisting of: a nucleotide sequence of SEQ ID NO:X wherein X is any integer as defined in Table 1; and a nucleotide sequence encoded by a human cDNA clone identified by a cDNA Clone Identifier in Table 1 and contained in the deposit with the ATCC Deposit Number shown for said cDNA clone in Table 1. The nucleic acid molecules can comprise DNA molecules or RNA molecules.

Also preferred is an isolated polypeptide comprising an amino acid sequence at least 90% identical to a sequence of at least about 10 contiguous amino acids in the amino acid sequence of SEQ ID NO:Y wherein Y is any integer as defined in Table 1.

Also preferred is a polypeptide, wherein said sequence of contiguous amino acids is included in the amino acid sequence of SEQ ID NO:Y in the range of positions beginning with the residue at about the position of the First Amino Acid of the Secreted Portion and ending with the residue at about the Last Amino Acid of the Open Reading Frame as set forth for SEQ ID NO:Y in Table 1.

Also preferred is an isolated polypeptide comprising an amino acid sequence at least 95% identical to a sequence of at least about 30 contiguous amino acids in the amino acid sequence of SEQ ID NO:Y.

Further preferred is an isolated polypeptide comprising an amino acid sequence at least 95% identical to a sequence of at least about 100 contiguous amino acids in the amino acid sequence of SEQ ID NO: Y.

Further preferred is an isolated polypeptide comprising an amino acid sequence at least 95% identical to the complete amino acid sequence of SEQ ID NO:Y.

Further preferred is an isolated polypeptide comprising an amino acid sequence at least 90% identical to a sequence of at least about 10 contiguous amino acids in the complete amino acid sequence of a secreted protein encoded by a human cDNA clone identified by a cDNA Clone Identifier in Table 1 and contained in the deposit with the ATCC Deposit Number shown for said cDNA clone in Table 1.

Also preferred is a polypeptide wherein said sequence of contiguous amino acids is included in the amino acid sequence of a secreted portion of the secreted protein encoded by a human cDNA clone identified by a cDNA Clone Identifier in Table 1 and contained in the deposit with the ATCC Deposit Number shown for said cDNA clone in Table 1.

Also preferred is an isolated polypeptide comprising an amino acid sequence at least 95% identical to a sequence of at least about 30 contiguous amino acids in the amino acid sequence of the secreted portion of the protein encoded by a human cDNA clone identified by a cDNA Clone Identifier in Table 1 and contained in the deposit with the ATCC Deposit Number shown for said cDNA clone in Table 1.

Also preferred is an isolated polypeptide comprising an amino acid sequence at least 95% identical to a sequence of at least about 100 contiguous amino acids in the amino acid sequence of the secreted portion of the protein encoded by a human cDNA clone identified by a cDNA Clone Identifier in Table 1 and contained in the deposit with the ATCC Deposit Number shown for said cDNA clone in Table 1.

Also preferred is an isolated polypeptide comprising an amino acid sequence at least 95% identical to the amino acid sequence of the secreted portion of the protein encoded by a human cDNA clone identified by a cDNA Clone Identifier in Table 1 and contained in the deposit with the ATCC Deposit Number shown for said cDNA clone in Table 1.

Further preferred is an isolated antibody which binds specifically to a polypeptide comprising an amino acid sequence that is at least 90% identical to a sequence of at least 10 contiguous amino acids in a sequence selected from the group consisting of: an amino acid sequence of SEQ ID NO:Y wherein Y is any integer as defined in Table 1; and a complete amino acid sequence of a protein encoded by a human cDNA clone identified by a cDNA Clone Identifier in Table 1 and contained in the deposit with the ATCC Deposit Number shown for said cDNA clone in Table 1.

Further preferred is a method for detecting in a biological sample a polypeptide comprising an amino acid sequence which is at least 90% identical to a sequence of at least 10 contiguous amino acids in a sequence selected from the group consisting of: an amino acid sequence of SEQ ID NO:Y wherein Y is any integer as defined in Table 1; and a complete amino acid sequence of a protein encoded by a human cDNA clone identified by a cDNA Clone Identifier in Table 1 and contained in the deposit with the ATCC Deposit Number shown for said cDNA clone in Table 1; which method comprises a step of comparing an amino acid sequence of at least one polypeptide molecule in said sample with a sequence selected from said group and determining whether the sequence of said polypeptide molecule in said sample is at least 90% identical to said sequence of at least 10 contiguous amino acids.

Also preferred is the above method wherein said step of comparing an amino acid sequence of at least one polypeptide molecule in said sample with a sequence selected from said group comprises determining the extent of specific binding of polypeptides in said sample to an antibody which binds specifically to a polypeptide comprising an amino acid sequence that is at least 90% identical to a sequence of at least 10 contiguous amino acids in a sequence selected from the group consisting of: an amino acid sequence of SEQ ID NO:Y wherein Y is any integer as defined in Table 1; and a complete amino acid sequence of a protein encoded by a human cDNA clone identified by a cDNA Clone Identifier in Table 1 and contained in the deposit with the ATCC Deposit Number shown for said cDNA clone in Table 1.

Also preferred is the above method wherein said step of comparing sequences is performed by comparing the amino acid sequence determined from a polypeptide molecule in said sample with said sequence selected from said group.

Also preferred is a method for identifying the species, tissue or cell type of a biological sample which method comprises a step of detecting polypeptide molecules in said sample, if any, comprising an amino acid sequence that is at least 90% identical to a sequence of at least 10 contiguous amino acids in a sequence selected from the group consisting of: an amino acid sequence of SEQ ID NO:Y wherein Y is any integer as defined in Table 1; and a complete amino acid sequence of a secreted protein encoded by a human cDNA clone identified by a cDNA Clone Identifier in Table 1 and contained in the deposit with the ATCC Deposit Number shown for said cDNA clone in Table 1.

Also preferred is the above method for identifying the species, tissue or cell type of a biological sample, which method comprises a step of detecting polypeptide molecules comprising an amino acid sequence in a panel of at least two amino acid sequences, wherein at least one sequence in said panel is at least 90% identical to a sequence of at least 10 contiguous amino acids in a sequence selected from the above group.

Also preferred is a method for diagnosing in a subject a pathological condition associated with abnormal structure or expression of a gene encoding a secreted protein identified in Table 1, which method comprises a step of detecting in a biological sample obtained from said subject polypeptide molecules comprising an amino acid sequence in a panel of at least two amino acid sequences, wherein at least one sequence in said panel is at least 90% identical to a sequence of at least 10 contiguous amino acids in a sequence selected from the group consisting of: an amino acid sequence of SEQ ID NO:Y wherein Y is any integer as defined in Table 1; and a complete amino acid sequence of a secreted protein encoded by a human cDNA clone identified by a cDNA Clone Identifier in Table 1 and contained in the deposit with the ATCC Deposit Number shown for said cDNA clone in Table 1.

In any of these methods, the step of detecting said polypeptide molecules includes using an antibody.

Also preferred is an isolated nucleic acid molecule comprising a nucleotide sequence which is at least 95% identical to a nucleotide sequence encoding a polypeptide wherein said polypeptide comprises an amino acid sequence that is at least 90% identical to a sequence of at least 10 contiguous amino acids in a sequence selected from the group consisting of: an amino acid sequence of SEQ ID NO:Y wherein Y is any integer as defined in Table 1; and a complete amino acid sequence of a secreted protein encoded by a human cDNA clone identified by a cDNA Clone Identifier in Table 1 and contained in the deposit with the ATCC Deposit Number shown for said cDNA clone in Table 1.

Also preferred is an isolated nucleic acid molecule, wherein said nucleotide sequence encoding a polypeptide has been optimized for expression of said polypeptide in a prokaryotic host.

Also preferred is an isolated nucleic acid molecule, wherein said polypeptide comprises an amino acid sequence selected from the group consisting of: an amino acid sequence of SEQ ID NO:Y wherein Y is any integer as defined in Table 1; and a complete amino acid sequence of a secreted protein encoded by a human cDNA clone identified by a cDNA Clone Identifier in Table 1 and contained in the deposit with the ATCC Deposit Number shown for said cDNA clone in Table 1.

Further preferred is a method of making a recombinant vector comprising inserting any of the above isolated nucleic acid molecule into a vector. Also preferred is the recombinant vector produced by this method. Also preferred is a method of making a recombinant host cell comprising introducing the vector into a host cell, as well as the recombinant host cell produced by this method.

Also preferred is a method of making an isolated polypeptide comprising culturing this recombinant host cell under conditions such that said polypeptide is expressed and recovering said polypeptide. Also preferred is this method of making an isolated polypeptide, wherein said recombinant host cell is a eukaryotic cell and said polypeptide is a secreted portion of a human secreted protein comprising an amino acid sequence selected from the group consisting of: an amino acid sequence of SEQ ID NO:Y beginning with the residue at the position of the First Amino Acid of the Secreted Portion of SEQ ID NO:Y wherein Y is an integer set forth in Table 1 and said position of the First Amino Acid of the Secreted Portion of SEQ ID NO:Y is defined in Table 1; and an amino acid sequence of a secreted portion of a protein encoded by a human cDNA clone identified by a cDNA Clone Identifier in Table 1 and contained in the deposit with the ATCC Deposit Number shown for said cDNA clone in Table 1. The isolated polypeptide produced by this method is also preferred.

Also preferred is a method of treatment of an individual in need of an increased level of a secreted protein activity, which method comprises administering to such an individual a pharmaceutical composition comprising an amount of an isolated polypeptide, polynucleotide, or antibody of the claimed invention effective to increase the level of said protein activity in said individual.

Having generally described the invention, the same will be more readily understood by reference to the following examples, which are provided by way of illustration and are not intended as limiting.

EXAMPLES

Example 1

Isolation of a Selected cDNA Clone From the Deposited Sample

Each cDNA clone in a cited ATCC deposit is contained in a plasmid vector. Table 1 identifies the vectors used to construct the cDNA library from which each clone was isolated. In many cases, the vector used to construct the library is a phage vector from which a plasmid has been excised. The table immediately below correlates the related plasmid for each phage vector used in constructing the cDNA library. For example, where a particular clone is identified in Table 1 as being isolated in the vector "Lambda Zap," the corresponding deposited clone is in "pBluescript."

| Vector Used to Construct Library | Corresponding Deposited Plasmid |
| --- | --- |
| Lambda Zap | pBluescript (pBS) |
| Uni-Zap XR | pBluescript (pBS) |
| Zap Express | pBK |
| lafmid BA | plafmid BA |
| pSport1 | pSport1 |
| pCMVSport 2.0 | pCMVSport 2.0 |
| pCMVSport 3.0 | pCMVSport 3.0 |
| pCR ® 2.1 | pCR ® 2.1 |

Vectors Lambda Zap (U.S. Pat. Nos. 5,128,256 and 5,286,636), Uni-Zap XR (U.S. Pat. Nos. 5,128, 256 and 5,286,636), Zap Express (U.S. Pat. Nos. 5,128,256 and 5,286,636), pBluescript (pBS) (Short, J. M. et al., Nucleic Acids Res. 16:7583–7600 (1988); Alting-Mees, M. A. and Short, J. M., Nucleic Acids Res. 17:9494 (1989)) and pBK (Alting-Mees, M. A. et al., Strategies 5:58–61 (1992)) are commercially available from Stratagene Cloning Systems, Inc., 11011 N. Torrey Pines Road, La Jolla, Calif., 92037. pBS contains an ampicillin resistance gene and pBK contains a neomycin resistance gene. Both can be transformed into E. coli strain XL-1 Blue, also available from Stratagene. pBS comes in 4 forms SK+, SK−, KS+ and KS. The S and K refers to the orientation of the polylinker to the T7 and T3 primer sequences which flank the polylinker region ("S" is for SacI and "K" is for KpnI which are the first sites on each respective end of the linker). "+" or "−" refer to the orientation of the f1 origin of replication ("ori"), such that in one orientation, single stranded rescue initiated from the f1 ori generates sense strand DNA and in the other, antisense.

Vectors pSport1, pCMVSport 2.0 and pCMVSport 3.0, were obtained from Life Technologies, Inc., P. O. Box 6009, Gaithersburg, Md. 20897. All Sport vectors contain an ampicillin resistance gene and may be transformed into E. coli strain DH 10B, also available from Life Technologies. (See, for instance, Gruber, C. E., et al., Focus 15:59 (1993).) Vector lafmid BA (Bento Soares, Columbia University, N.Y.) contains an ampicillin resistance gene and can be transformed into E. coli strain XL-1 Blue. Vector pCR®2.1, which is available from Invitrogen, 1600 Faraday Avenue, Carlsbad, Calif. 92008, contains an ampicillin resistance gene and may be transformed into E. coli strain DH10B, available from Life Technologies. (See, for instance, Clark, J. M., Nuc. Acids Res. 16:9677–9686 (1988) and Mead, D. et al., Bio/Technology 9: (1991).) Preferably, a polynucleotide of the present invention does not comprise the phage vector sequences identified for the particular clone in Table 1, as well as the corresponding plasmid vector sequences designated above.

The deposited material in the sample assigned the ATCC Deposit Number cited in Table 1 for any given cDNA clone also may contain one or more additional plasmids, each comprising a cDNA clone different from that given clone. Thus, deposits sharing the same ATCC Deposit Number contain at least a plasmid for each cDNA clone identified in Table 1. Typically, each ATCC deposit sample cited in Table 1 comprises a mixture of approximately equal amounts (by weight) of about 50 plasmid DNAs, each containing a different cDNA clone; but such a deposit sample may include plasmids for more or less than 50 cDNA clones, up to about 500 cDNA clones.

Two approaches can be used to isolate a particular clone from the deposited sample of plasmid DNAs cited for that clone in Table 1. First, a plasmid is directly isolated by screening the clones using a polynucleotide probe corresponding to SEQ ID NO:X.

Particularly, a specific polynucleotide with 30–40 nucleotides is synthesized using an Applied Biosystems DNA synthesizer according to the sequence reported. The oligonucleotide is labeled, for instance, with $^{32}$P-γ-ATP using T4 polynucleotide kinase and purified according to routine methods. (E.g. Maniatis et al., Molecular Cloning: A Laboratory Manual, Cold Spring Harbor Press, Cold Spring, N.Y. (1982).) The plasmid mixture is transformed into a suitable host, as indicated above (such as XL-1 Blue (Stratagene)) using techniques known to those of skill in the art, such as those provided by the vector supplier or in related publications or patents cited above. The transformants are plated on 1.5% agar plates (containing the appropriate selection agent, e.g. ampicillin) to a density of about 150 transformants (colonies) per plate. These plates are screened using Nylon membranes according to routine methods for bacterial colony screening (e.g. Sambrook et al., Molecular Cloning: A Laboratory Manual, 2nd Edit., (1989), Cold Spring Harbor Laboratory Press, pages 1.93 to 1.104), or other techniques known to those of skill in the art.

Alternatively, two primers of 17–20 nucleotides derived from both ends of the SEQ ID NO:X (i.e., within the region of SEQ ID NO:X bounded by the 5' NT and the 3' NT of the clone defined in Table 1) are synthesized and used to amplify the desired cDNA using the deposited cDNA plasmid as a template. The polymerase chain reaction is carried out under routine conditions, for instance, in 25 μl of reaction mixture with 0.5 ug of the above cDNA template. A convenient reaction mixture is 1.5–5 mM MgCl$_2$, 0.01% (w/v) gelatin, 20 μM each of dATP, dCTP, dGTP, dTTP, 25 pmol of each primer and 0.25 Unit of Taq polymerase. Thirty five cycles of PCR (denaturation at 94° C. for 1 min; annealing at 55° C. for 1 min; elongation at 72° C. for 1 min) are performed with a Perkin-Elmer Cetus automated thermal cycler. The amplified product is analyzed by agarose gel electrophoresis and the DNA band with expected molecular weight is excised and purified. The PCR product is verified to be the selected sequence by subcloning and sequencing the DNA product.

Several methods are available for the identification of the 5' or 3' non-coding portions of a gene which may not be present in the deposited clone. These methods include but are not limited to, filter probing, clone enrichment using specific probes, and protocols similar or identical to 5' and 3' "RACE" protocols which are well known in the art. For instance, a method similar to 5' RACE is available for generating the missing 5' end of a desired full-length transcript. (Fromont-Racine et al., Nucleic Acids Res. 21(7):1683–1684 (1993).)

Briefly, a specific RNA oligonucleotide is ligated to the 5' ends of a population of RNA presumably containing full-length gene RNA transcripts. A primer set containing a primer specific to the ligated RNA oligonucleotide and a primer specific to a known sequence of the gene of interest is used to PCR amplify the 5' portion of the desired full-length gene. This amplified product may then be sequenced and used to generate the full length gene.

This above method starts with total RNA isolated from the desired source, although poly-A+RNA can be used. The RNA preparation can then be treated with phosphatase if necessary to eliminate 5' phosphate groups on degraded or damaged RNA which may interfere with the later RNA ligase step. The phosphatase should then be inactivated and the RNA treated with tobacco acid pyrophosphatase in order to remove the cap structure present at the 5' ends of messenger RNAs. This reaction leaves a 5' phosphate group at the 5' end of the cap cleaved RNA which can then be ligated to an RNA oligonucleotide using T4 RNA ligase.

This modified RNA preparation is used as a template for first strand cDNA synthesis using a gene specific oligonucleotide. The first strand synthesis reaction is used as a template for PCR amplification of the desired 5' end using a primer specific to the ligated RNA oligonucleotide and a primer specific to the known sequence of the gene of interest. The resultant product is then sequenced and analyzed to confirm that the 5' end sequence belongs to the desired gene.

Example 2

Isolation of Genomic Clones Corresponding to a Polynucleotide

A human genomic P1 library (Genomic Systems, Inc.) is screened by PCR using primers selected for the cDNA sequence corresponding to SEQ ID NO:X., according to the method described in Example 1. (See also, Sambrook.)

Example 3

Tissue Distribution of Polypeptide

Tissue distribution of MRNA expression of polynucleotides of the present invention is determined using protocols for Northern blot analysis, described by, among others, Sambrook et al. For example, a cDNA probe produced by the method described in Example 1 is labeled with $P^{32}$ using the rediprime™ DNA labeling system (Amersham Life Science), according to manufacturer's instructions. After labeling, the probe is purified using CHROMA SPIN-100™ column (Clontech Laboratories, Inc.), according to manufacturer's protocol number PT 1200-1. The purified labeled probe is then used to examine various human tissues for mRNA expression.

Multiple Tissue Northern (MTN) blots containing various human tissues (H) or human immune system tissues (IM) (Clontech) are examined with the labeled probe using ExpressHyb™ hybridization solution (Clontech) according to manufacturer's protocol number PT1190-1. Following hybridization and washing, the blots are mounted and exposed to film at −70° C. overnight, and the films developed according to standard procedures.

Example 4

Chromosomal Mapping of the Polynucleotides

An oligonucleotide primer set is designed according to the sequence at the 5' end of SEQ ID NO:X. This primer preferably spans about 100 nucleotides. This primer set is then used in a polymerase chain reaction under the following set of conditions: 30 seconds, 95° C.; 1 minute, 56° C; 1 minute, 70° C. This cycle is repeated 32 times followed by one 5 minute cycle at 70° C.

Human, mouse, and hamster DNA is used as template in addition to a somatic cell hybrid panel containing individual chromosomes or chromosome fragments (Bios, Inc). The reactions is analyzed on either 8% polyacrylamide gels or 3.5% agarose gels. Chromosome mapping is determined by the presence of an approximately 100 bp PCR fragment in the particular somatic cell hybrid.

Example 5

Bacterial Expression of a Polypeptide

A polynucleotide encoding a polypeptide of the present invention is amplified using PCR oligonucleotide primers corresponding to the 5' and 3' ends of the DNA sequence, as outlined in Example 1, to synthesize insertion fragments. The primers used to amplify the cDNA insert should preferably contain restriction sites, such as BanHI and XbaI, at the 5' end of the primers in order to clone the amplified product into the expression vector. For example, BamHI and XbaI correspond to the restriction enzyme sites on the bacterial expression vector pQE-9. (Qiagen, Inc., Chatsworth, Calif.). This plasmid vector encodes antibiotic resistance (Amp$^r$), a bacterial origin of replication (ori), an IPTG-regulatable promoter/operator (P/O), a ribosome binding site (RBS), a 6-histidine tag (6-His), and restriction enzyme cloning sites.

The pQE-9 vector is digested with BamHI and XbaI and the amplified fragment is ligated into the pQE-9 vector maintaining the reading frame initiated at the bacterial RBS. The ligation mixture is then used to transform the E. coli strain M15/rep4 (Qiagen, Inc.) which contains multiple copies of the plasmid pREP4, which expresses the lacI repressor and also confers kanamycin resistance (Kan$^r$). Transformants are identified by their ability to grow on LB plates and ampicillin/kanamycin resistant colonies are selected. Plasmid DNA is isolated and confirmed by restriction analysis.

Clones containing the desired constructs are grown overnight (O/N) in liquid culture in LB media supplemented with both Amp (100 ug/ml) and Kan (25 ug/ml). The O/N culture is used to inoculate a large culture at a ratio of 1:100 to 1:250. The cells are grown to an optical density 600 (O.D.$^{600}$) of between 0.4 and 0.6. IPTG (Isopropyl-B-D-thiogalacto pyranoside) is then added to a final concentration of 1 mM. IPTG induces by inactivating the lacd repressor, clearing the P/O leading to increased gene expression.

Cells are grown for an extra 3 to 4 hours. Cells are then harvested by centrifugation (20 mins at 6000×g). The cell pellet is solubilized in the chaotropic agent 6 Molar Guanidine HCl by stirring for 3–4 hours at 4° C. The cell debris is removed by centrifugation, and the supernatant containing the polypeptide is loaded onto a nickel-nitrilo-tri-acetic acid ("Ni-NTA") affinity resin column (available from QIAGEN, Inc., supra). Proteins with a 6× His tag bind to the Ni-NTA resin with high affinity and can be purified in a simple one-step procedure (for details see: The QIAexpressionist (1995) QIAGEN, Inc., supra).

Briefly, the supernatant is loaded onto the column in 6 M guanidine-HCl, pH 8, the column is first washed with 10 volumes of 6 M guanidine-HCl, pH 8, then washed with 10 volumes of 6 M guanidine-HCl pH 6, and finally the polypeptide is eluted with 6 M guanidine-HCl, pH 5.

The purified protein is then renatured by dialyzing it against phosphate-buffered saline (PBS) or 50 mM Na-acetate, pH 6 buffer plus 200 mM NaCl. Alternatively, the protein can be successfully refolded while immobilized on the Ni-NTA column. The recommended conditions are as follows: renature using a linear 6M–1M urea gradient in 500 mM NaCl, 20% glycerol, 20 mM Tris/HCl pH 7.4, containing protease inhibitors. The renaturation should be performed over a period of 1.5 hours or more. After renaturation the proteins are eluted by the addition of 250 mM immidazole. Immidazole is removed by a final dialyzing step against PBS or 50 mM sodium acetate pH 6 buffer plus 200 mM NaCl. The purified protein is stored at 4° C. or frozen at −80° C.

In addition to the above expression vector, the present invention further includes an expression vector comprising phage operator and promoter elements operatively linked to a polynucleotide of the present invention, called pHE4a. (ATCC Accession Number 209645, deposited on Feb. 25, 1998.) This vector contains: 1) a neomycinphosphotransferase gene as a selection marker, 2) an *E. coli* origin of replication, 3) a T5 phage promoter sequence, 4) two lac operator sequences, 5) a Shine-Delgarno sequence, and 6) the lactose operon repressor gene (lacIq). The origin of replication (oriC) is derived from pUC19 (LTI, Gaithersburg, Md.). The promoter sequence and operator sequences are made synthetically.

DNA can be inserted into the pHEa by restricting the vector with NdeI and XbaI, BamHI, XhoI, or Asp718, running the restricted product on a gel, and isolating the larger fragment (the stuffer fragment should be about 310 base pairs). The DNA insert is generated according to the PCR protocol described in Example 1, using PCR primers having restriction sites for NdeI (5' primer) and XbaI, BamHI, XhoI, or Asp718 (3' primer). The PCR insert is gel purified and restricted with compatible enzymes. The insert and vector are ligated according to standard protocols.

The engineered vector could easily be substituted in the above protocol to express protein in a bacterial system.

Example 6

Purification of a Polypeptide from an Inclusion Body

The following alternative method can be used to purify a polypeptide expressed in *E coli* when it is present in the form of inclusion bodies. Unless otherwise specified, all of the following steps are conducted at 4–10° C.

Upon completion of the production phase of the *E. coli* fermentation, the cell culture is cooled to 4–10° C. and the cells harvested by continuous centrifugation at 15,000 rpm (Heraeus Sepatech). On the basis of the expected yield of protein per unit weight of cell paste and the amount of purified protein required, an appropriate amount of cell paste, by weight, is suspended in a buffer solution containing 100 mM Tris, 50 mM EDTA, pH 7.4. The cells are dispersed to a homogeneous suspension using a high shear mixer.

The cells are then lysed by passing the solution through a microfluidizer (Microfuidics, Corp. or APV Gaulin, Inc.) twice at 4000–6000 psi. The homogenate is then mixed with NaCl solution to a final concentration of 0.5 M NaCl, followed by centrifugation at 7000×g for 15 min. The resultant pellet is washed again using 0.5M NaCl, 100 mM Tris, 50 mM EDTA, pH 7.4.

The resulting washed inclusion bodies are solubilized with 1.5 M guanidine hydrochloride (GuHCl) for 2–4 hours. After 7000×g centrifugation for 15 min., the pellet is discarded and the polypeptide containing supernatant is incubated at 4° C. overnight to allow further GuHCl extraction.

Following high speed centrifugation (30,000×g) to remove insoluble particles, the GuHCl solubilized protein is refolded by quickly mixing the GuHCl extract with 20 volumes of buffer containing 50 mM sodium, pH 4.5, 150 mM NaCl, 2 mM EDTA by vigorous stirring. The refolded diluted protein solution is kept at 4° C. without mixing for 12 hours prior to further purification steps.

To clarify the refolded polypeptide solution, a previously prepared tangential filtration unit equipped with 0.16 μm membrane filter with appropriate surface area (e.g. Filtron), equilibrated with 40 mM sodium acetate, pH 6.0 is employed. The filtered sample is loaded onto a cation exchange resin (e.g. Poros HS-50, Perseptive Biosystems). The column is washed with 40 mM sodium acetate, pH 6.0 and eluted with 250 mM, 500 mM, 1000 mM, and 1500 mM NaCl in the same buffer, in a stepwise manner. The absorbance at 280 nm of the effluent is continuously monitored. Fractions are collected and further analyzed by SDS-PAGE.

Fractions containing the polypeptide are then pooled and mixed with 4 volumes of water. The diluted sample is then loaded onto a previously prepared set of tandem columns of strong anion (Poros HQ-50, Perseptive Biosystems) and weak anion (Poros CM-20, Perseptive Biosystems) exchange resins. The columns are equilibrated with 40 mM sodium acetate, pH 6.0. Both columns are washed with 40 mM sodium acetate, pH 6.0, 200 mM NaCl. The CM-20 column is then eluted using a 10 column volume linear gradient ranging from 0.2 M NaCl, 50 mM sodium acetate, pH 6.0 to 1.0 M NaCl, 50 mM sodium acetate, pH 6.5. Fractions are collected under constant $A_{280}$ monitoring of the effluent. Fractions containing the polypeptide (determined, for instance, by 16% SDS-PAGE) are then pooled.

The resultant polypeptide should exhibit greater than 95% purity after the above refolding and purification steps. No major contaminant bands should be observed from Commassie blue stained 16% SDS-PAGE gel when 5 μg of purified protein is loaded. The purified protein can also be tested for endotoxin/LPS contamination, and typically the LPS content is less than 0.1 ng/ml according to LAL assays.

Example 7

Cloning and Expression of a Polypeptide in a Baculovirus Expression System

In this example, the plasmid shuttle vector pA2 is used to insert a polynucleotide into a baculovirus to express a polypeptide. This expression vector contains the strong polyhedrin promoter of the *Autographa californica* nuclear polyhedrosis virus (AcMNPV) followed by convenient restriction sites such as BamHI, Xba I and Asp718. The polyadenylation site of the simian virus 40 ("SV40") is used for efficient polyadenylation. For easy selection of recombinant virus, the plasmid contains the beta-galactosidase gene from *E. coli* under control of a weak Drosophila promoter in the same orientation, followed by the polyadenylation signal of the polyhedrin gene. The inserted genes are flanked on both sides by viral sequences for cell-mediated homologous recombination with wild-type viral DNA to generate a viable virus that express the cloned polynucleotide.

Many other baculovirus vectors can be used in place of the vector above, such as pAc373, pVL941, and pAcIM1, as one skilled in the art would readily appreciate, as long as the construct provides appropriately located signals for transcription, translation, secretion and the like, including a signal peptide and an in-frame AUG as required. Such vectors are described, for instance, in Luckow et al., Virology 170:31–39 (1989).

Specifically, the cDNA sequence contained in the deposited clone, including the AUG initiation codon and the naturally associated leader sequence identified in Table 1, is amplified using the PCR protocol described in Example 1. If the naturally occurring signal sequence is used to produce the secreted protein, the pA2 vector does not need a second signal peptide. Alternatively, the vector can be modified (pA2 GP) to include a baculovirus leader sequence, using the standard methods described in Summers et al., "A Manual of Methods for Baculovirus Vectors and Insect Cell Culture Procedures," Texas Agricultural Experimental Station Bulletin No. 1555 (1987).

The amplified fragment is isolated from a 1% agarose gel using a commercially available kit ("Geneclean," BIO 101 Inc., La Jolla, Calif.). The fragment then is digested with appropriate restriction enzymes and again purified on a 1% agarose gel.

The plasmid is digested with the corresponding restriction enzymes and optionally, can be dephosphorylated using calf intestinal phosphatase, using routine procedures known in the art. The DNA is then isolated from a 1% agarose gel using a commercially available kit ("Geneclean" BIO 101 Inc., La Jolla, Calif.).

The fragment and the dephosphorylated plasmid are ligated together with T4 DNA ligase. *E. coli* HB 101 or other suitable *E. coli* hosts such as XL-1 Blue (Stratagene Cloning Systems, La Jolla, CA) cells are transformed with the ligation mixture and spread on culture plates. Bacteria containing the plasmid are identified by digesting DNA from individual colonies and analyzing the digestion product by gel electrophoresis. The sequence of the cloned fragment is confirmed by DNA sequencing.

Five µg of a plasmid containing the polynucleotide is co-transfected with 1.0 µg of a commercially available linearized baculovirus DNA ("BaculoGold™ baculovirus DNA", Pharmingen, San Diego, Calif.), using the lipofection method described by Felgner et al., Proc. Natl. Acad. Sci. USA 84:7413–7417 (1987). One µg of BaculoGold™ virus DNA and 5 µg of the plasmid are mixed in a sterile well of a microtiter plate containing 50 µl of serum-free Grace's medium (Life Technologies Inc., Gaithersburg, Md.). Afterwards, 10 µl Lipofectin plus 90 µl Grace's medium are added, mixed and incubated for 15 minutes at room temperature. Then the transfection mixture is added drop-wise to Sf9 insect cells (ATCC CRL 1711) seeded in a 35 mm tissue culture plate with 1 ml Grace's medium without serum. The plate is then incubated for 5 hours at 27° C. The transfection solution is then removed from the plate and 1 ml of Grace's insect medium supplemented with 10% fetal calf serum is added. Cultivation is then continued at 27° C. for four days.

After four days the supernatant is collected and a plaque assay is performed, as described by Summers and Smith, supra. An agarose gel with "Blue Gal" (Life Technologies Inc., Gaithersburg) is used to allow easy identification and isolation of gal-expressing clones, which produce blue-stained plaques. (A detailed description of a "plaque assay" of this type can also be found in the user's guide for insect cell culture and baculovirology distributed by Life Technologies Inc., Gaithersburg, page 9–10.) After appropriate incubation, blue stained plaques are picked with the tip of a micropipettor (e.g. Eppendorf). The agar containing the recombinant viruses is then resuspended in a microcentrifuge tube containing 200 µl of Grace's medium and the suspension containing the recombinant baculovirus is used to infect Sf9 cells seeded in 35 mm dishes. Four days later the supernatants of these culture dishes are harvested and then they are stored at 40° C.

To verify the expression of the polypeptide, Sf9 cells are grown in Grace's medium supplemented with 10% heat-inactivated FBS. The cells are infected with the recombinant baculovirus containing the polynucleotide at a multiplicity of infection ("MOI") of about 2. If radiolabeled proteins are desired, 6 hours later the medium is removed and is replaced with SF900 II medium minus methionine and cysteine (available from Life Technologies Inc., Rockville, Md.). After 42 hours, 5 µCi of $^{35}$S-methionine and 5 µCi $^{35}$S-cysteine (available from Amersham) are added. The cells are further incubated for 16 hours and then are harvested by centrifugation. The proteins in the supernatant as well as the intracellular proteins are analyzed by SDS-PAGE followed by autoradiography (if radiolabeled).

Microsequencing of the amino acid sequence of the amino terminus of purified protein may be used to determine the amino terminal sequence of the produced protein.

Example 8

Expression of a Polypeptide in Mammalian Cells

The polypeptide of the present invention can be expressed in a mammalian cell. A typical mammalian expression vector contains a promoter element, which mediates the initiation of transcription of MRNA, a protein coding sequence, and signals required for the termination of transcription and polyadenylation of the transcript. Additional elements include enhancers, Kozak sequences and intervening sequences flanked by donor and acceptor sites for RNA splicing. Highly efficient transcription is achieved with the early and late promoters from SV40, the long terminal repeats (LTRs) from Retroviruses, e.g. RSV, HTLVI, HIVI and the early promoter of the cytomegalovirus (CMV). However, cellular elements can also be used (e.g. the human actin promoter).

Suitable expression vectors for use in practicing the present invention include, for example, vectors such as pSVL and pMSG (Pharmacia, Uppsala, Sweden), pRSVcat (ATCC 37152), pSV2dhfr (ATCC 37146), pBC12MI (ATCC 67109), pCMVSport 2.0, and pCMVSport 3.0. Mammalian host cells that could be used include, human Hela, 293, H9 and Jurkat cells, mouse NIH3T3 and C127 cells, Cos 1, Cos 7 and CV1, quail QC1–3 cells, mouse L cells and Chinese hamster ovary (CHO) cells.

Alternatively, the polypeptide can be expressed in stable cell lines containing the polynucleotide integrated into a chromosome. The co-transfection with a selectable marker such as dhfr, gpt, neomycin, hygromycin allows the identification and isolation of the transfected cells.

The transfected gene can also be amplified to express large amounts of the encoded protein. The DHFR (dihydrofolate reductase) marker is useful in developing cell lines that carry several hundred or even several thousand copies of the gene of interest. (See, e.g. Alt, F. W., et al., J. Biol. Chem. 253:1357–1370 (1978); Hamlin, J. L. and Ma, C., Biochem. et Biophys. Acta, 1097:107–143 (1990); Page, M. J. and Sydenham, M. A., Biotechnology 9:64–68 (1991).) Another useful selection marker is the enzyme glutamine synthase (GS) (Murphy et al., Biochem J. 227:277–279 (1991); Bebbington et al., Bio/Technology 10:169–175 (1992). Using these markers, the mammalian cells are grown in selective medium and the cells with the highest resistance are selected. These cell lines contain the amplified gene(s) integrated into a chromosome. Chinese hamster ovary (CHO) and NSO cells are often used for the production of proteins.

Derivatives of the plasmid pSV2-dhfr (ATCC Accession No. 37146), the expression vectors pC4 (ATCC Accession No. 209646) and pC6 (ATCC Accession No.209647) contain the strong promoter (LTR) of the Rous Sarcoma Virus (Cullen et al., Molecular and Cellular Biology, 438–447 (March, 1985)) plus a fragment of the CMV-enhancer (Boshart et al., Cell 41:521–530 (1985).) Multiple cloning sites, e.g. with the restriction enzyme cleavage sites BamHI, XbaI and Asp718, facilitate the cloning of the gene of interest. The vectors also contain the 3' intron, the polyadenylation and termination signal of the rat preproinsulin gene, and the mouse DHFR gene under control of the SV40 early promoter.

Specifically, the plasmid pC6, for example, is digested with appropriate restriction enzymes and then dephosphorylated using calf intestinal phosphates by procedures known in the art. The vector is then isolated from a 1% agarose gel.

A polynucleotide of the present invention is amplified according to the protocol outlined in Example 1. If the naturally occurring signal sequence is used to produce the secreted protein, the vector does not need a second signal peptide. Alternatively, if the naturally occurring signal sequence is not used, the vector can be modified to include a heterologous signal sequence. (See, e.g. WO 96/34891.)

The amplified fragment is isolated from a 1% agarose gel using a commercially available kit ("Geneclean," BIO 101 Inc., La Jolla, Calif.). The fragment then is digested with appropriate restriction enzymes and again purified on a 1% agarose gel.

The amplified fragment is then digested with the same restriction enzyme and purified on a 1% agarose gel. The isolated fragment and the dephosphorylated vector are then ligated with T4 DNA ligase. E. coli HB 101 or XL-1 Blue cells are then transformed and bacteria are identified that contain the fragment inserted into plasmid pC6 using, for instance, restriction enzyme analysis.

Chinese hamster ovary cells lacking an active DHFR gene is used for transfection. Five μg of the expression plasmid pC6 is cotransfected with 0.5 μg of the plasmid pSVneo using lipofectin (Felgner et al., supra). The plasmid pSV2-neo contains a dominant selectable marker, the neo gene from Tn5 encoding an enzyme that confers resistance to a group of antibiotics including G418. The cells are seeded in alpha minus MEM supplemented with 1 mg/mil G418. After 2 days, the cells are trypsinized and seeded in hybridoma cloning plates (Greiner, Germany) in alpha minus MEM supplemented with 10, 25, or 50 ng/ml of metothrexate plus 1 mg/ml G418. After about 10–14 days single clones are trypsinized and then seeded in 6-well petri dishes or 10 ml flasks using different concentrations of methotrexate (50 nM, 100 nM, 200 nM, 400 nM, 800 nM). Clones growing at the highest concentrations of methotrexate are then transferred to new 6-well plates containing even higher concentrations of methotrexate (1 μM, 2 μM, 5 μM, 10 mM, 20 mM). The same procedure is repeated until clones are obtained which grow at a concentration of 100–200 μM. Expression of the desired gene product is analyzed, for instance, by SDS-PAGE and Western blot or by reversed phase HPLC analysis.

Example 9

Protein Fusions

The polypeptides of the present invention are preferably fused to other proteins. These fusion proteins can be used for a variety of applications. For example, fusion of the present polypeptides to His-tag, HA-tag, protein A, IgG domains, and maltose binding protein facilitates purification. (See Example 5; see also EP A 394,827; Traunecker, et al., Nature 331:84–86 (1988).) Similarly, fusion to IgG-1, IgG-3, and albumin increases the halflife time in vivo. Nuclear localization signals fused to the polypeptides of the present invention can target the protein to a specific subcellular localization, while covalent heterodimer or homodimers can increase or decrease the activity of a fusion protein. Fusion proteins can also create chimeric molecules having more than one function. Finally, fusion proteins can increase solubility and/or stability of the fused protein compared to the non-fused protein. All of the types of fusion proteins described above can be made by modifying the following protocol, which outlines the fusion of a polypeptide to an IgG molecule, or the protocol described in Example 5.

Briefly, the human Fc portion of the IgG molecule can be PCR amplified, using primers that span the 5' and 3' ends of the sequence described below. These primers also should have convenient restriction enzyme sites that will facilitate cloning into an expression vector, preferably a mammalian expression vector.

For example, if pC4 (Accession No. 209646) is used, the human Fc portion can be ligated into the BamHI cloning site. Note that the 3' BamHI site should be destroyed. Next, the vector containing the human Fc portion is re-restricted with BamHI, linearizing the vector, and a polynucleotide of the present invention, isolated by the PCR protocol described in Example 1, is ligated into this BamHI site. Note that the polynucleotide is cloned without a stop codon, otherwise a fusion protein will not be produced.

If the naturally occurring signal sequence is used to produce the secreted protein, pC4 does not need a second signal peptide. Alternatively, if the naturally occurring signal sequence is not used, the vector can be modified to include a heterologous signal sequence. (See, e.g. WO 96/34891.)

Human IgG Fc region: GGGATCCGGAGCCCAAATCT-
TCTGACAAAACTCACACATGCCCACCGT-
GCCCAGCAC CTGAATTCGAGGGTGCACCGT-
CAGTCTTCCTCTTCCCCCCAAAACCCAAGGACA
CCCTCATGATCTCCCGGACTCCTGAGGTCA- CATGCGTGGTGGTGGACGTAAGCCACGAAGA
CCCTGAGGTCAAGTTCAACTGGTACGTG-
GACGGCGTGGAGGTGCATAATGCCAAGAC AAAGC-
CGCGGGAGGAGCAGTACAACAGCACG-
TACCGTGTGGTCAGCGTCCTCACCG
TCCTGCACCAGGACTGGCTGAATG-
GCAAGGAGTACAAGTGCAAGGTCTCCAACAAAG
CCCTCCCAACCCCCATCGAGAAAAC-
CATCTCCAAAGCCAAAGGGCAGCCCCGAGAAC
CACAGGTGTACACCCTGCCCCCATC-
CCGGGATGAGCTGACCAAGAACCAGGTCAGCC
TGACCTGCCTGGTCAAAGGCTTCTATC-
CAAGCGACATCGCCGTGGAGTGGGAGAGCA
ATGGGCAGCCGGAGAACAACTACAAGAC-
CACGCCTCCCGTGCTGGACTCCGACGGCT CCTTCT-
TCCTCTACAGCAAGCTCACCGTGGACAA-
GAGCAGGTGGCAGCAGGGGAACG
TCTTCTCATGCTCCGTGATGCATGAG-
GCTCTGCACAACCACTACACGCAGAAGAGCCT
CTCCCTGTCTCCGGGTAAATGAGTGC-
GACGGCCGCGACTCTAGAGGAT (SEQ ID NO:1)

Example 10

Production of an Antibody from a Polypeptide

The antibodies of the present invention can be prepared by a variety of methods. (See, Current Protocols, Chapter 2.) For example, cells expressing a polypeptide of the present invention is administered to an animal to induce the production of sera containing polyclonal antibodies. In a preferred method, a preparation of the secreted protein is prepared and purified to render it substantially free of natural contaminants. Such a preparation is then introduced into an animal in order to produce polyclonal antisera of greater specific activity.

In the most preferred method, the antibodies of the present invention are monoclonal antibodies (or protein binding fragments thereof). Such monoclonal antibodies can be prepared using hybridoma technology. (Kohler et al., Nature 256:495 (1975); Köhler et al., Eur. J. Immunol. 6:511 (1976); Köhler et al., Eur. J. Immunol. 6:292 (1976); Hammerling et al., in: Monoclonal Antibodies and T-Cell Hybridomas, Elsevier, N.Y., pp. 563–681 (1981).) In general, such procedures involve immunizing an animal (preferably a mouse) with polypeptide or, more preferably, with a secreted polypeptide-expressing cell. Such cells may be cultured in any suitable tissue culture medium; however, it is preferable to culture cells in Earle's modified Eagle's medium supplemented with 10% fetal bovine serum (inactivated at about 56° C.), and supplemented with about 10 g/l of nonessential amino acids, about 1,000 U/ml of penicillin, and about 100 μg/mil of streptomycin.

The splenocytes of such mice are extracted and fused with a suitable myeloma cell line. Any suitable myeloma cell line may be employed in accordance with the present invention; however, it is preferable to employ the parent myeloma cell line (SP20), available from the ATCC. After fusion, the resulting hybridoma cells are selectively maintained in HAT medium, and then cloned by limiting dilution as described by Wands et al. (Gastroenterology 80:225–232 (1981).) The hybridoma cells obtained through such a selection are then assayed to identify clones which secrete antibodies capable of binding the polypeptide.

Alternatively, additional antibodies capable of binding to the polypeptide can be produced in a two-step procedure using anti-idiotypic antibodies. Such a method makes use of the fact that antibodies are themselves antigens, and therefore, it is possible to obtain an antibody which binds to a second antibody. In accordance with this method, protein specific antibodies are used to immunize an animal, preferably a mouse. The splenocytes of such an animal are then used to produce hybridoma cells, and the hybridoma cells are screened to identify clones which produce an antibody whose ability to bind to the protein-specific antibody can be blocked by the polypeptide. Such antibodies comprise anti-idiotypic antibodies to the protein-specific antibody and can be used to immunize an animal to induce formation of further protein-specific antibodies.

It will be appreciated that Fab and F(ab')2 and other fragments of the antibodies of the present invention may be used according to the methods disclosed herein. Such fragments are typically produced by proteolytic cleavage, using enzymes such as papain (to produce Fab fragments) or pepsin (to produce F(ab')2 fragments). Alternatively, secreted protein-binding fragments can be produced through the application of recombinant DNA technology or through synthetic chemistry.

For in vivo use of antibodies in humans, it may be preferable to use "humanized" chimeric monoclonal antibodies. Such antibodies can be produced using genetic constructs derived from hybridoma cells producing the monoclonal antibodies described above. Methods for producing chimeric antibodies are known in the art. (See, for review, Morrison, Science 229:1202 (1985); Oi et al., BioTechniques 4:214 (1986); Cabilly et al., U.S. Pat. No. 4,816,567; Taniguchi et al., EP 171496; Morrison et al., EP 173494; Neuberger et al., WO 8601533; Robinson et al., WO 8702671; Boulianne et al., Nature 312:643 (1984); Neuberger et al., Nature 314:268 (1985).)

Example 11

Production Of Secreted Protein For High-Throughput Screening Assays

The following protocol produces a supernatant containing a polypeptide to be tested. This supernatant can then be used in the Screening Assays described in Examples 13–20.

First, dilute Poly-D-Lysine (644 587 Boehringer-Mannheim) stock solution (1 mg/ml in PBS) 1:20 in PBS (w/o calcium or magnesium 17–516F Biowhittaker) for a working solution of 50 μg/ml. Add 200 μl of this solution to each well (24 well plates) and incubate at RT for 20 minutes. Be sure to distribute the solution over each well (note: a 12-channel pipetter may be used with tips on every other channel). Aspirate off the Poly-D-Lysine solution and rinse with 1 mI PBS (Phosphate Buffered Saline). The PBS should remain in the well until just prior to plating the cells and plates may be poly-lysine coated in advance for up to two weeks.

Plate 293T cells (do not carry cells past P+20) at $2 \times 10^5$ cells/well in .5ml DMEM(Dulbecco's Modified Eagle Medium)(with 4.5 G/L glucose and L-glutarmine (12–604F Biowhittaker))/10% heat inactivated FBS(14–503F Biowhittaker)/1× Penstrep(17-602E Biowhittaker). Let the cells grow overnight.

The next day, mix together in a sterile solution basin: 300 μl Lipofectamine (18324–012 Gibco/BRL) and 5 ml Opti-mem I (31985070 Gibco/BRL)/96-well plate. With a small volume multi-channel pipetter, aliquot approximately 2 ug of an expression vector containing a polynucleotide insert, produced by the methods described in Examples 8 or 9, into an appropriately labeled 96-well round bottom plate. With a multi-channel pipetter, add 50 ul of the Lipofectamine/ Optimem I mixture to each well. Pipette up and down gently to mix. Incubate at RT 15–45 minutes. After about 20 minutes, use a multi-channel pipetter to add 150 ul Optimem I to each well. As a control, one plate of vector DNA lacking an insert should be transfected with each set of transfections.

Preferably, the transfection should be performed by tag-teaming the following tasks. By tag-teaming, hands on time is cut in half, and the cells do not spend too much time on PBS. First, person A aspirates off the media from four 24-well plates of cells, and then person B rinses each well with .5-1 ml PBS. Person A then aspirates off PBS rinse, and person B, using a 12-channel pipetter with tips on every other channel, adds the 200 ul of DNA/Lipofectamine/ Optimem I complex to the odd wells first, then to the even wells, to each row on the 24-well plates. Incubate at 37° C. for 6 hours.

While cells are incubating, prepare appropriate media, either 1%BSA in DMEM with 1× penstrep, or CHO-5 media (116.6 mg/L of CaCl2 (anhyd); 0.00130 mg/L $CuSO_4$-$5H_2O$; 0.050 mg/L of $Fe(NO_3)_3$-$9H_2O$; 0.417 mg/L of $FeSO_4$-$7H_2O$; 311.80 mg/L of Kcl; 28.64 mg/L of $MgCl_2$; 48.84 mg/L of $MgSO_4$; 6995.50 mg/L of NaCl; 2400.0 mg/L of $NaHCO_3$; 62.50 mg/L of $NaH_2PO_4$-$H_2O$; 71.02 mg/L of $Na_2HPO4$; .4320 mg/L of $ZnSO_4$-$7H_2O$; .002 mg/L of Arachido Acid; 1.022 mgAL of Cholesterol; .070 mg/L of DL-alpha-Tocopherol-Acetate; 0.0520 mg/L of Linoleic Acid; 0.010 mg/L of Linolenic Acid; 0.010 mg/L of Myristic Acid; 0.010 mg/L of Oleic Acid; 0.010 mg/L of Palmitric Acid; 0.010 mg/L of Palmitic Acid; 100 mg/L of Pluronic F-68; 0.010 mg/L of Stearic Acid; 2.20 mg/L of Tween 80; 4551 mg/L of D-Glucose; 130.85 mg/ml of L-Alanine; 147.50 mg/ml of L-Arginine-HCL; 7.50 mg/ml of L-Asparagine-$H_2O$; 6.65 mg/ml of L-Aspartic Acid; 29.56 mg/ml of L-Cystine-2HCL-$H_2O$; 31.29 mg/ml of L-Cystine-2HCL; 7.35 mg/mil of L-Glutamic Acid; 365.0 mg/ml of L-Glutamine; 18.75 mg/ml of Glycine; 52.48 mg/ml of L-Histidine-HCL-$H_2O$; 106.97 mg/ml of L-Isoleucine; 111.45 mg/ml of L-Leucine; 163.75 mg/ml of L-Lysine HCL; 32.34 mg/ml of L-Methionine; 68.48 mg/ml of L-Phenylalainine; 40.0 mg/ml of L-Proline; 26.25 mg/ml of L-Serine; 101.05 mg/ml of L-Threonine; 19.22 mg/ml of L-Tryptophan; 91.79 mg/ml of L-Tryrosine-2Na-$2H_2O$; 99.65 mg/ml of L-Valine; 0.0035 mg/L of Biotin; 3.24 mg/L of D-Ca Pantothenate; 11.78 mg/L of Choline Chloride; 4.65 mg/L of Folic Acid; 15.60 mg/L of i-Inositol; 3.02 mg/L of Niacinamide; 3.00 mg/L of Pyridoxal HCL; 0.031 mg/L of Pyridoxine HCL; 0.319 mg/L of Riboflavin; 3.17 mg/L of Thiamine HCL; 0.365 mg/L of Thymidine; and 0.680 mg/L of Vitamin $B_{12}$; 25 mM of HEPES Buffer; 2.39 mg/L of Na Hypoxanthine; 0.105 mg/L of Lipoic Acid; 0.081 mg/L of Sodium Putrescine-2HCL; 55.0 mg/L of Sodium Pyruvate; 0.0067 mg/L of Sodium Selenite; 20 uM of Ethanolamine; 0.122 mg/L of Ferric Citrate; 41.70 mg/L of Methyl-B-Cyclodextrin complexed with Linoleic Acid; 33.33 mg/L of Methyl-B-Cyclodextrin complexed with Oleic Acid; and 10 mg/L of Methyl-B-Cyclodextrin complexed with Retinal) with 2 mm glutamine and 1× penstrep. (BSA (81-068-3 Bayer) 100 gm dissolved in IL DMEM for a 10% BSA stock solution). Filter the media and collect 50 ul for endotoxin assay in 15 ml polystyrene conical.

The transfection reaction is terminated, preferably by tag-teaming, at the end of the incubation period. Person A aspirates off the transfection media, while person B adds 1.5 ml appropriate media to each well. Incubate at 37° C. for 45 or 72 hours depending on the media used: 1%BSA for 45 hours or CHO-5 for 72 hours.

On day four, using a 300 ul multichannel pipetter, aliquot 600 ul in one 1 ml deep well plate and the remaining supernatant into a 2 ml deep well. The supernatants from each well can then be used in the assays described in Examples 13–20.

It is specifically understood that when activity is obtained in any of the assays described below using a supernatant, the activity originates from either the polypeptide directly (e.g. as a secreted protein) or by the polypeptide inducing expression of other proteins, which are then secreted into the supernatant. Thus, the invention further provides a method of identifying the protein in the supernatant characterized by an activity in a particular assay.

Example 12

Construction of GAS Reporter Construct

One signal transduction pathway involved in the differentiation and proliferation of cells is called the Jaks-STATs pathway. Activated proteins in the Jaks-STATs pathway bind to gamma activation site "GAS" elements or interferon-sensitive responsive element ("ISRE"), located in the promoter of many genes. The binding of a protein to these elements alter the expression of the associated gene.

GAS and ISRE elements are recognized by a class of transcription factors called Signal Transducers and Activators of Transcription, or "STATs." There are six members of the STATs family. StatI and Stat3 are present in many cell types, as is Stat2 (as response to IFN-alpha is widespread). Stat4 is more restricted and is not in many cell types though it has been found in T helper class I, cells after treatment with IL-12. Stat5 was originally called mammary growth factor, but has been found at higher concentrations in other cells including myeloid cells. It can be activated in tissue culture cells by many cytokines.

The STATs are activated to translocate from the cytoplasm to the nucleus upon tyrosine phosphorylation by a set of kinases known as the Janus Kinase ("Jaks") family. Jaks represent a distinct family of soluble tyrosine kinases and include Tyk2, Jak1, Jak3, and Jak3. These kinases display significant sequence similarity and are generally catalytically inactive in resting cells.

The Jaks are activated by a wide range of receptors summarized in the Table below. (Adapted from review by Schidler and Darnell, Ann. Rev. Biochem. 64:621–51 (1995) .) A cytokine receptor family, capable of activating Jaks, is divided into two groups: (a) Class 1 includes receptors for IL-2, IL-3, IL-4, IL-6, IL-7, IL-9, IL-11, IL-12, IL-15, Epo, PRL, G-CSF, GM-CSF, LIF, CNTF, and thrombopoietin; and (b) Class 2 includes IFN-a, IFN-g, and IL-10. The Class 1 receptors share a conserved cysteine motif (a set of four conserved cysteines and one tryptophan) and a WSXWS motif (a membrane proxial region encoding Trp-Ser-Xxx-Trp-Ser (SEQ ID NO:2)).

Thus, on binding of a ligand to a receptor, Jaks are activated, which in turn activate STATs, which then translocate and bind to GAS elements. This entire process is encompassed in the Jaks-STATs signal transduction pathway.

Therefore, activation of the Jaks-STATs pathway, reflected by the binding of the GAS or the ISRE element, can be used to indicate proteins involved in the proliferation and differentiation of cells. For example, growth factors and cytokines are known to activate the Jaks-STATs pathway. (See Table below.) Thus, by using GAS elements linked to reporter molecules, activators of the Jaks-STATs pathway can be identified.

| Ligand | JAKs | | | | STATS | GAS(elements) or ISRE |
|---|---|---|---|---|---|---|
| | tyk2 | Jak1 | Jak2 | Jak3 | | |
| IFN family | | | | | | |
| IFN-a/B | + | + | − | − | 1, 2, 3 | ISRE |
| IFN-g | | + | + | − | 1 | GAS (IRF1>Lys6>IFP) |
| Il-10 | + | ? | ? | − | 1, 3 | |
| gp130 family | | | | | | |
| IL-6 (Pleiotrohic) | + | + | + | ? | 1, 3 | GAS (IRF1>Lys6>IFP) |
| Il-11 (Pleiotrohic) | ? | + | ? | ? | 1, 3 | |
| OnM(Pleiotrohic) | ? | + | + | ? | 1, 3 | |
| LIF(Pleiotrohic) | ? | + | + | ? | 1, 3 | |
| CNTF(Pleiotrohic) | −/+ | + | + | ? | 1, 3 | |
| G-CSF(Pleiotrohic) | ? | + | ? | ? | 1, 3 | |
| IL-12(Pleiotrohic) | + | − | + | + | 1, 3 | |
| g-C family | | | | | | |
| IL-2 (lymphocytes) | − | + | − | + | 1, 3, 5 | GAS |
| IL-4 (lymph/myeloid) >>Ly6)(IgH) | − | + | − | + | 6 | GAS (IRF1 = IFP |
| IL-7 (lymphocytes) | − | + | − | + | 5 | GAS |
| IL-9 (lymphocytes) | − | + | − | + | 5 | GAS |
| IL-13 (lymphocyte) | − | + | ? | ? | 6 | GAS |
| IL-15 | ? | + | ? | + | 5 | GAS |
| gp140 family | | | | | | |
| IL-3 (myeloid) | − | − | + | − | 5 | GAS (IRF1>IFP>>Ly6) |
| IL-5 (myeloid) | − | − | + | − | 5 | GAS |
| GM-CSF (myeloid) | − | − | + | − | 5 | GAS |
| Growth hormone family | | | | | | |
| GH | ? | − | + | − | 5 | |
| PRL | ? | +/− | + | − | 1, 3, 5 | |
| EPO | ? | − | + | − | 5 | GAS(B- CAS>IRFI = IFP>>Ly6) |
| Receptor Tyrosine Kinases | | | | | | |
| EGF | ? | + | + | − | 1, 3 | GAS (IRF1) |
| PDGF | ? | + | + | − | 1, 3 | |
| CSF-1 | ? | + | + | − | 1, 3 | GAS (not IRF1) |

To construct a synthetic GAS containing promoter element, which is used in the Biological Assays described in Examples 13–14, a PCR based strategy is employed to generate a GAS-SV40 promoter sequence. The 5' primer contains four tandem copies of the GAS binding site found in the IRF1 promoter and previously demonstrated to bind STATs upon induction with a range of cytokines (Rothman et al., Immunity 1:457–468 (1994).), although other GAS or ISRE elements can be used instead. The 5' primer also contains 18bp of sequence complementary to the SV40 early promoter sequence and is flanked with an XhoI site. The sequence of the 5' primer is: 5':GCGCCTCGAGATTTC-CCCGAAATCTAGATTTCCCCGAAAT-GATTTCCCCGAAATGAT TTCCCCGAAATATCTGC-CATCTCAATTAG:3' (SEQ ID NO:3)

The downstream primer is complementary to the SV40 promoter and is flanked with a Hind III site: 5':GCG-GCAAGCTTTTTGCAAAGCCTAGGC:3' (SEQ ID NO:4)

PCR amplification is performed using the SV40 promoter template present in the B-gal:promoter plasmid obtained from Clontech. The resulting PCR fragment is digested with XhoI/Hind III and subcloned into BLSK2-. (Stratagene.) Sequencing with forward and reverse primers confirms that the insert contains the following sequence:

5':CTCGAGAT TCCCCGAAATCTAGATTTC-CCCGAAATGATITCCCCGAAATGATTTCC CCGAAATATCTGCCATCTCAATTAGT- CAGCAACCATAGTCCCGCCCCTAACTCCGCCC ATC-CCGCCCCTAACTCCGCCCAGTTCCGC-CCATTCTCCGCCCCATGGCTGACTAATTTT TTTTATTTATGCAGAGGCCGAGGCCGC-CTCGGCCTCTGAGCTATTCCAGAAGTAGTGA GGAGGCTTTTTTGGAGGCCTAG-GCTTTTGCAAAAAGCTT:3' (SEQ ID NO:5)

With this GAS promoter element linked to the SV40 promoter, a GAS:SEAP2 reporter construct is next engineered. Here, the reporter molecule is a secreted alkaline phosphatase, or "SEAP." Clearly, however, any reporter molecule can be instead of SEAP, in this or in any of the other Examples. Well known reporter molecules that can be used instead of SEAP include chloramphenicol acetyltransferase (CAT), luciferase, alkaline phosphatase, B-galactosidase, green fluorescent protein (GFP), or any protein detectable by an antibody.

The above sequence confirmed synthetic GAS-SV40 promoter element is subcloned into the pSEAP-Promoter vector obtained from Clontech using HindIII and XhoI, effectively replacing the SV40 promoter with the amplified GAS:SV40 promoter element, to create the GAS-SEAP vector. However, this vector does not contain a neomycin resistance gene, and therefore, is not preferred for mammalian expression systems.

Thus, in order to generate mammalian stable cell lines expressing the GAS-SEAP reporter, the GAS-SEAP cassette is removed from the GAS-SEAP vector using SalI and NotI, and inserted into a backbone vector containing the neomycin resistance gene, such as pGFP-1 (Clontech), using these restriction sites in the multiple cloning site, to create the GAS-SEAP/Neo vector. Once this vector is transfected into mammalian cells, this vector can then be used as a reporter molecule for GAS binding as described in Examples 13–14.

Other constructs can be made using the above description and replacing GAS with a different promoter sequence. For example, construction of reporter molecules containing NFK-B and EGR promoter sequences are described in Examples 15 and 16. However, many other promoters can be substituted using the protocols described in these Examples. For instance, SRE, IL-2, NFAT, or Osteocalcin promoters can be substituted, alone or in combination (e.g. GAS/NF-KB/EGR, GAS/NF-KB, Il-2/NFAT, or NF-KB/GAS). Similarly, other cell lines can be used to test reporter construct activity, such as HELA (epithelial), HUVEC (endothelial), Reh (B-cell), Saos-2 (osteoblast), HUVAC (aortic), or Cardiomyocyte.

Example 13

High-Throughput Screening Assay for T-cell Activity.

The following protocol is used to assess T-cell activity by identifying factors, such as growth factors and cytokines, that may proliferate or differentiate T-cells. T-cell activity is assessed using the GAS/SEAP/Neo construct produced in Example 12. Thus, factors that increase SEAP activity indicate the ability to activate the Jaks-STATS signal transduction pathway. The T-cell used in this assay is Jurkat T-cells (ATCC Accession No. TIB-152), although Molt-3 cells (ATCC Accession No. CRL-1552) and Molt-4 cells (ATCC Accession No. CRL-1582) cells can also be used.

Jurkat T-cells are lymphoblastic CD4+Th1 helper cells. In order to generate stable cell lines, approximately 2 million Jurkat cells are transfected with the GAS-SEAP/neo vector using DMRIE-C (Life Technologies)(transfection procedure described below). The transfected cells are seeded to a density of approximately 20,000 cells per well and transfectants resistant to 1 mg/ml genticin selected. Resistant colonies are expanded and then tested for their response to increasing concentrations of interferon gamma. The dose response of a selected clone is demonstrated.

Specifically, the following protocol will yield sufficient cells for 75 wells containing 200 ul of cells. Thus, it is either scaled up, or performed in multiple to generate sufficient cells for multiple 96 well plates. Jurkat cells are maintained in RPMI+10% serum with 1% Pen-Strep. Combine 2.5 mls of OPTI-MEM (Life Technologies) with 10 ug of plasmid DNA in a T25 flask. Add 2.5 ml OPTI-MEM containing 50 ul of DMRIE-C and incubate at room temperature for 15–45 mins.

During the incubation period, count cell concentration, spin down the required number of cells ($10^7$ per transfection), and resuspend in OPTI-MEM to a final concentration of $10^7$ cells/ml. Then add Imi of $1 \times 10^7$ cells in OPTI-MEM to T25 flask and incubate at 37° C. for 6 hrs. After the incubation, add 10 ml of RPMI+15% serum.

The Jurkat:GAS-SEAP stable reporter lines are maintained in RPMI +10% serum, 1 mg/ml Genticin, and 1% Pen-Strep. These cells are treated with supernatants containing a polypeptide as produced by the protocol described in Example 11.

On the day of treatment with the supernatant, the cells should be washed and resuspended in fresh RPMI+10% serum to a density of 500,000 cells per ml. The exact number of cells required will depend on the number of supernatants being screened. For one 96 well plate, approximately 10 million cells (for 10 plates, 100 million cells) are required.

Transfer the cells to a triangular reservoir boat, in order to dispense the cells into a 96 well dish, using a 12 channel pipette. Using a 12 channel pipette, transfer 200 ul of cells into each well (therefore adding 100,000 cells per well).

After all the plates have been seeded, 50 ul of the supernatants are transferred directly from the 96 well plate containing the supernatants into each well using a 12 channel pipette. In addition, a dose of exogenous interferon gamma (0.1, 1.0, 10 ng) is added to wells H9, H10, and H11 to serve as additional positive controls for the assay.

The 96 well dishes containing Jurkat cells treated with supernatants are placed in an incubator for 48 hrs (note: this time is variable between 48–72 hrs). 35 ul samples from each well are then transferred to an opaque 96 well plate using a 12 channel pipette. The opaque plates should be covered (using sellophene covers) and stored at −20° C. until SEAP assays are performed according to Example 17. The plates containing the remaining treated cells are placed at 4° C. and serve as a source of material for repeating the assay on a specific well if desired.

As a positive control, 100 Unit/ml interferon gamma can be used which is known to activate Jurkat T cells. Over 30 fold induction is typically observed in the positive control wells.

Example 14

High-Throughput Screening Assay Identifying Myeloid Activity

The following protocol is used to assess myeloid activity by identifying factors, such as growth factors and cytokines, that may proliferate or differentiate myeloid cells. Myeloid cell activity is assessed using the GAS/SEAP/Neo construct produced in Example 12. Thus, factors that increase SEAP activity indicate the ability to activate the Jaks-STATS signal transduction pathway. The myeloid cell used in this assay is U937, a pre-monocyte cell line, although TF-1, HL60, or KG1 can be used.

To transiently transfect U937 cells with the GAS/SEAP/Neo construct produced in Example 12, a DEAE-Dextran method (Kharbanda et. al., 1994, Cell Growth & Differentiation, 5:259–265) is used. First, harvest $2 \times 10e^7$ U937 cells and wash with PBS. The U937 cells are usually grown in RPMI 1640 medium containing 10% heat-inactivated fetal bovine serum (FBS) supplemented with 100 units/ml penicillin and 100 mg/ml streptomycin.

Next, suspend the cells in 1 ml of 20 mM Tris-HCl (pH 7.4) buffer containing 0.5 mg/ml DEAE-Dextran, 8 ug GAS-SEAP2 plasmid DNA, 140 mM NaCl, 5 mM KCl, 375 uM $Na_2HPO_4.7H_2O$, 1 mM $MgCl_2$, and 675 uM $CaCl_2$. Incubate at 37° C. for 45 min.

Wash the cells with RPMI 1640 medium containing 10% FBS and then resuspend in 10 ml complete medium and incubate at 37° C. for 36 hr.

The GAS-SEAP/U937 stable cells are obtained by growing the cells in 400 ug/ml G418. The G418-free medium is used for routine growth but every one to two months, the cells should be re-grown in 400 ug/ml G418 for couple of passages.

These cells are tested by harvesting $1 \times 10^8$ cells (this is enough for ten 96-well plates assay) and wash with PBS.

Suspend the cells in 200 ml above described growth medium, with a final density of $5 \times 10^5$ cells/ml. Plate 200 ul cells per well in the 96-well plate (or $1 \times 10^5$ cells/well).

Add 50 ul of the supernatant prepared by the protocol described in Example 11. Incubate at 37° C. for 48 to 72 hr. As a positive control, 100 Unit/ml interferon gamma can be used which is known to activate U937 cells. Over 30 fold induction is typically observed in the positive control wells. SEAP assay the supernatant according to the protocol described in Example 17.

Example 15

High-Throughput Screening Assay Identifying Neuronal Activity.

When cells undergo differentiation and proliferation, a group of genes are activated through many different signal transduction pathways. One of these genes, EGR1 (early growth response gene 1), is induced in various tissues and cell types upon activation. The promoter of EGR1 is responsible for such induction. Using the EGR1 promoter linked to reporter molecules, activation of cells can be assessed.

Particularly, the following protocol is used to assess neuronal activity in PC12 cell lines. PC12 cells (rat phenochromocytoma cells) are known to proliferate and/or differentiate by activation with a number of mitogens, such as TPA (tetradecanoyl phorbol acetate), NGF (nerve growth factor), and EGF (epidermal growth factor). The EGR1 gene expression is activated during this treatment. Thus, by stably transfecting PC12 cells with a construct containing an EGR promoter linked to SEAP reporter, activation of PC12 cells can be assessed.

The EGR/SEAP reporter construct can be assembled by the following protocol. The EGR-1 promoter sequence (−633 to +1)(Sakamoto K et al., Oncogene 6:867–871 (1991)) can be PCR amplified from human genomic DNA using the following primers:

5' GCGCTCGAGGGATGACAGCGATAGAACCCCGG -3' (SEQ ID NO:6)

5' GCGAAGCTTCGCGACTCCCCGGATCCGCCTC-3' (SEQ ID NO:7)

Using the GAS:SEAP/Neo vector produced in Example 12, EGR1 amplified product can then be inserted into this vector. Linearize the GAS:SEAP/Neo vector using restriction enzymes XhoI/HindIII, removing the GAS/SV40 stuffer. Restrict the EGR1 amplified product with these same enzymes. Ligate the vector and the EGR1 promoter.

To prepare 96 well-plates for cell culture, two mls of a coating solution (1:30 dilution of collagen type I (Upstate Biotech Inc. Cat#08-115) in 30% ethanol (filter sterilized)) is added per one 10 cm plate or 50 ml per well of the 96-well plate, and allowed to air dry for 2 hr.

PC12 cells are routinely grown in RPMI-1640 medium (Bio Whittaker) containing 10% horse serum (JRH BIOSCIENCES, Cat. #12449-78P), 5% heat-inactivated fetal bovine serum (FBS) supplemented with 100 units/ml penicillin and 100 ug/ml streptomycin on a precoated 10 cm tissue culture dish. One to four split is done every three to four days. Cells are removed from the plates by scraping and resuspended with pipetting up and down for more than 15 times.

Transfect the EGR/SEAP/Neo construct into PC12 using the Lipofectamine protocol described in Example 11. EGR-SEAP/PC12 stable cells are obtained by growing the cells in 300 ug/ml G418. The G418-free medium is used for routine growth but every one to two months, the cells should be re-grown in 300 ug/ml G418 for couple of passages.

To assay for neuronal activity, a 10 cm plate with cells around 70 to 80% confluent is screened by removing the old medium. Wash the cells once with PBS (Phosphate buffered saline). Then starve the cells in low serum medium (RPMI-1640 containing 1% horse serum and 0.5% FBS with antibiotics) overnight.

The next morning, remove the medium and wash the cells with PBS. Scrape off the cells from the plate, suspend the cells well in 2 ml low serum medium. Count the cell number and add more low serum medium to reach final cell density as $5 \times 10^5$ cells/ml.

Add 200 ul of the cell suspension to each well of 96-well plate (equivalent to $1 \times 10^5$ cells/well). Add 50 ul supernatant produced by Example 11, 37° C. for 48 to 72 hr. As a positive control, a growth factor known to activate PC12 cells through EGR can be used, such as 50 ng/ul of Neuronal Growth Factor (NGF). Over fifty-fold induction of SEAP is typically seen in the positive control wells. SEAP assay the supernatant according to Example 17.

Example 16

High-Throughput Screening Assay for T-cell Activity

NF-kB (Nuclear Factor kB) is a transcription factor activated by a wide variety of agents including the inflammatory cytokines IL-1 and TNF, CD30 and CD40, lymphotoxin-alpha and lymphotoxin-beta, by exposure to LPS or thrombin, and by expression of certain viral gene products. As a transcription factor, NF-kB regulates the expression of genes involved in immune cell activation, control of apoptosis (NF-kB appears to shield cells from apoptosis), B and T-cell development, anti-viral and antimicrobial responses, and multiple stress responses.

In non-stimulated conditions, NF-kB is retained in the cytoplasm with I-kB (Inhibitor kB). However, upon stimulation, I-kB is phosphorylated and degraded, causing NF-kB to shuttle to the nucleus, thereby activating transcription of target genes. Target genes activated by NF-kB include IL-2, IL-6, GM-CSF, ICAM-1 and class 1 MHC.

Due to its central role and ability to respond to a range of stimuli, reporter constructs utilizing the NF-kB promoter element are used to screen the supernatants produced in Example 11. Activators or inhibitors of NF-KB would be useful in treating diseases. For example, inhibitors of NF-kB could be used to treat those diseases related to the acute or chronic activation of NF-kB, such as rheumatoid arthritis.

To construct a vector containing the NF-KB promoter element, a PCR based strategy is employed. The upstream primer contains four tandem copies of the NF-kB binding site (GGGGACTTTCCC) (SEQ ID NO:8), 18 bp of sequence complementary to the 5' end of the SV40 early promoter sequence, and is flanked with an XhoI site:

5':GCGGCCTCGAGGGGACTTTCCCGGG-GACTTTCCGGGGACTTTCCGGGACTTTCCA TCCTGCCATCTCAATTAG:3' (SEQ ID NO:9)

The downstream primer is complementary to the 3' end of the SV40 promoter and is flanked with a Hind III site:

5':GCGGCAAGCTTTTTGCAAAGCCTAGGC:3' (SEQ ID NO:4)

PCR amplification is performed using the SV40 promoter template present in the pB-gal:promoter plasmid obtained from Clontech. The resulting PCR fragment is digested with XhoI and Hind III and subdloned into BLSK2-. (Stratagene) Sequencing with the T7 and T3 primers confirms the insert contains the following sequence:

5':CTCGAGGGGACTTTCCCGGGGACTTTC-
CGGGGACTTTCCGGGACTTTCCATCTGCC ATCT-
CAATIAGTCAGCAACCATAGTCCCGC-
CCCTAACTCCGCCCATCCGCCCCTAAC
TCCGCCCAGTTCCGCCCATTCTCCGC-
CCCATGGCTGACTAATTTTTTTATTTATGCAG
AGGCCGAGGCCGCCTCGGCCTCTGAGC-
TATTCCAGAAGTAGTGAGGAGGCTTTTTTG
GAGGCCTAGGCT=TTGCAAAAAGCTT:3' (SEQ ID NO: 10)

Next, replace the SV40 minimal promoter element present in the pSEAP2-promoter plasmid (Clontech) with this NF-kB/SV40 fragment using XhoI and HindIII. However, this vector does not contain a neomycin resistance gene, and therefore, is not preferred for mammalian expression systems.

In order to generate stable mammalian cell lines, the NF-kB/SV40/SEAP cassette is removed from the above NF-kB/SEAP vector using restriction enzymes SalI and NotI, and inserted into a vector containing neomycin resistance. Particularly, the NF-kB/SV40/SEAP cassette was inserted into pGFP-1 (Clontech), replacing the GFP gene, after restricting pGFP-1 with SalI and NotI.

Once NF-kB/SV40/SEAP/Neo vector is created, stable Jurkat T-cells are created and maintained according to the protocol described in Example 13. Similarly, the method for assaying supernatants with these stable Jurkat T-cells is also described in Example 13. As a positive control, exogenous TNF alpha (0.1,1, 10 ng) is added to wells H9, H10, and H11, with a 5–10 fold activation typically observed.

Example 17

Assay for SEAP Activity

As a reporter molecule for the assays described in Examples 13–16, SEAP activity is assayed using the Tropix Phospho-light Kit (Cat. BP-400) according to the following general procedure. The Tropix Phospho-light Kit supplies the Dilution, Assay, and Reaction Buffers used below.

Prime a dispenser with the 2.5× Dilution Buffer and dispense 15 µl of 2.5× dilution buffer into Optiplates containing 35 µl of a supernatant. Seal the plates with a plastic sealer and incubate at 65° C. for 30 min. Separate the Optiplates to avoid uneven heating.

Cool the samples to room temperature for 15 minutes. Empty the dispenser and prime with the Assay Buffer. Add 50 µl Assay Buffer and incubate at room temperature 5 min. Empty the dispenser and prime with the Reaction Buffer (see the table below). Add 50 µl Reaction Buffer and incubate at room temperature for 20 minutes. Since the intensity of the chemiluminescent signal is time dependent, and it takes about 10 minutes to read 5 plates on luminometer, one should treat 5 plates at each time and start the second set 10 minutes later.

Read the relative light unit in the luminometer. Set H12 as blank, and print the results. An increase in chemiluminescence indicates reporter activity.

Reaction Buffer Formulation:

| # of plates | Rxn buffer diluent (ml) | CSPD (ml) |
|---|---|---|
| 10 | 60 | 3 |
| 11 | 65 | 3.25 |
| 12 | 70 | 3.5 |
| 13 | 75 | 3.75 |
| 14 | 80 | 4 |
| 15 | 85 | 4.25 |
| 16 | 90 | 4.5 |
| 17 | 95 | 4.75 |
| 18 | 100 | 5 |
| 19 | 105 | 5.25 |
| 20 | 110 | 5.5 |
| 21 | 115 | 5.75 |
| 22 | 120 | 6 |
| 23 | 125 | 6.25 |
| 24 | 130 | 6.5 |
| 25 | 135 | 6.75 |
| 26 | 140 | 7 |
| 27 | 145 | 7.25 |
| 28 | 150 | 7.5 |
| 29 | 155 | 7.75 |
| 30 | 160 | 8 |
| 31 | 165 | 8.25 |
| 32 | 170 | 8.5 |
| 33 | 175 | 8.75 |
| 34 | 180 | 9 |
| 35 | 185 | 9.25 |
| 36 | 190 | 9.5 |
| 37 | 195 | 9.75 |
| 38 | 200 | 10 |
| 39 | 205 | 10.25 |
| 40 | 210 | 10.5 |
| 41 | 215 | 10.75 |
| 42 | 220 | 11 |
| 43 | 225 | 11.25 |
| 44 | 230 | 11.5 |
| 45 | 235 | 11.75 |
| 46 | 240 | 12 |
| 47 | 245 | 12.25 |
| 48 | 250 | 12.5 |
| 49 | 255 | 12.75 |
| 50 | 260 | 13 |

Example 18

High-Throughput Screening Assay Identifying Changes in Small Molecule Concentration and Membrane Permeability Binding of a ligand to a receptor is known to alter intracellular levels of small molecules, such as calcium, potassium, sodium, and pH, as well as alter membrane potential. These alterations can be measured in an assay to identify supernatants which bind to receptors of a particular cell. Although the following protocol describes an assay for calcium, this protocol can easily be modified to detect changes in potassium, sodium, pH, membrane potential, or any other small molecule which is detectable by a fluorescent probe.

The following assay uses Fluorometric Imaging Plate Reader ("FLIPR") to measure changes in fluorescent molecules (Molecular Probes) that bind small molecules. Clearly, any fluorescent molecule detecting a small molecule can be used instead of the calcium fluorescent molecule, fluo-3, used here.

For adherent cells, seed the cells at 10,000–20,000 cells/well in a Co-star black 96-well plate with clear bottom. The plate is incubated in a $CO_2$ incubator for 20 hours. The adherent cells are washed two times in Biotek washer with 200 ul of HBSS (Hank's Balanced Salt Solution) leaving 100 ul of buffer after the final wash.

A stock solution of 1 mg/ml fluo-3 is made in 10% pluronic acid DMSO. To load the cells with fluo-3, 50 ul of 12 ug/ml fluo-3 is added to each well. The plate is incubated at 37° C. in a $CO_2$ incubator for 60 min. The plate is washed four times in the Biotek washer with HBSS leaving 100 ul of buffer.

For non-adherent cells, the cells are spun down from culture media. Cells are resuspended to $2-5 \times 10^6$ cells/ml with HBSS in a 50-ml conical tube. 4 ul of 1 mg/mil fluo-3 solution in 10% pluronic acid DMSO is added to each ml of cell suspension. The tube is then placed in a 37° C. water bath for 30–60 min. The cells are washed twice with HBSS, resuspended to $1 \times 10^6$ cells/ml, and dispensed into a microplate, 100 ul/well. The plate is centrifuged at 1000 rpm for 5 min. The plate is then washed once in Denley CellWash with 200 ul, followed by an aspiration step to 100 ul final volume.

For a non-cell based assay, each well contains a fluorescent molecule, such as fluo-3. The supernatant is added to the well, and a change in fluorescence is detected.

To measure the fluorescence of intracellular calcium, the FLIPR is set for the following parameters: (1) System gain is 300–800 mW; (2) Exposure time is 0.4 second; (3) Camera F/stop is F/2; (4) Excitation is 488 nm; (5) Emission is 530 nm; and (6) Sample addition is 50 ul. Increased emission at 530 nm indicates an extracellular signaling event which has resulted in an increase in the intracellular Ca++ concentration.

Example 19

High-Throughput Screening Assay Identifying Tyrosine Kinase Activity

The Protein Tyrosine Kinases (PTK) represent a diverse group of transmembrane and cytoplasmic kinases. Within the Receptor Protein Tyrosine Kinase RPTK) group are receptors for a range of mitogenic and metabolic growth factors including the PDGF, FGF, EGF, NGF, HGF and Insulin receptor subfamilies. In addition there are a large family of RPTKs for which the corresponding ligand is unknown. Ligands for RPTKs include mainly secreted small proteins, but also membrane-bound and extracellular matrix proteins.

Activation of RPTK by ligands involves ligand-mediated receptor dimerization, resulting in transphosphorylation of the receptor subunits and activation of the cytoplasmic tyrosine kinases. The cytoplasmic tyrosine kinases include receptor associated tyrosine kinases of the src-family (e.g. src, yes, lck, lyn, fyn) and non-receptor linked and cytosolic protein tyrosine kinases, such as the Jak family, members of which mediate signal transduction triggered by the cytokine superfamily of receptors (e.g. the Interleukins, Interferons, GM-CSF, and Leptin).

Because of the wide range of known factors capable of stimulating tyrosine kinase activity, the identification of novel human secreted proteins capable of activating tyrosine kinase signal transduction pathways are of interest. Therefore, the following protocol is designed to identify those novel human secreted proteins capable of activating the tyrosine kinase signal transduction pathways.

Seed target cells (e.g. primary keratinocytes) at a density of approximately 25,000 cells per well in a 96 well Loprodyne Silent Screen Plates purchased from Nalge Nunc (Naperville, Ill.). The plates are sterilized with two 30 minute rinses with 100% ethanol, rinsed with water and dried overnight. Some plates are coated for 2 hr with 100 ml of cell culture grade type I collagen (50 mg/ml), gelatin (2%) or polylysine (50 mg/ml), all of which can be purchased from Sigma Chemicals (St. Louis, Mo.) or 10% Matrigel purchased from Becton Dickinson (Bedford, Mass.), or calf serum, rinsed with PBS and stored at 4° C. Cell growth on these plates is assayed by seeding 5,000 cells/well in growth medium and indirect quantitation of cell number through use of alamarBlue as described by the manufacturer Alamar Biosciences, Inc. (Sacramento, Calif.) after 48 hr. Falcon plate covers #3071 from Becton Dickinson (Bedford, Mass.) are used to cover the Loprodyne Silent Screen Plates. Falcon Microtest III cell culture plates can also be used in some proliferation experiments.

To prepare extracts, A431 cells are seeded onto the nylon membranes of Loprodyne plates (20,000/2 ml/well) and cultured overnight in complete medium. Cells are quiesced by incubation in serum-free basal medium for 24 hr. After 5–20 minutes treatment with EGF (60 ng/ml) or 50 ul of the supernatant produced in Example 11, the medium was removed and 100 ml of extraction buffer ((20 mM HEPES pH 7.5, 0.15 M NaCl, 1% Triton X-100, 0.1% SDS, 2 mM Na3VO4, 2 mM Na4P207 and a cocktail of protease inhibitors (#1836170) obtained from Boeheringer Mannheim (Indianapolis, Ind.) is added to each well and the plate is shaken on a rotating shaker for 5 minutes at 4° C. The plate is then placed in a vacuum transfer manifold and the extract filtered through the 0.45 mm membrane bottoms of each well using house vacuum. Extracts are collected in a 96-well catch/assay plate in the bottom of the vacuum manifold and immediately placed on ice. To obtain extracts clarified by centrifugation, the content of each well, after detergent solubilization for 5 minutes, is removed and centrifuged for 15 minutes at 4° C. at 16,000×g.

Test the filtered extracts for levels of tyrosine kinase activity. Although many methods of detecting tyrosine kinase activity are known, one method is described here.

Generally, the tyrosine kinase activity of a supernatant is evaluated by determining its ability to phosphorylate a tyrosine residue on a specific substrate (a biotinylated peptide). Biotinylated peptides that can be used for this purpose include PSK1 (corresponding to amino acids 6–20 of the cell division kinase cdc2-p34) and PSK2 (corresponding to amino acids 1×17 of gastrin). Both peptides are substrates for a range of tyrosine kinases and are available from Boehringer Mannheim.

The tyrosine kinase reaction is set up by adding the following components in order. First, add 10 ul of 5 uM Biotinylated Peptide, then 10 ul ATP/$Mg_{2+}$ (5 mM ATP/50 mM $MgCl_2$), then 10 ul of 5× Assay Buffer (40 mM imidazole hydrochloride, pH7.3, 40 mM beta-glycerophosphate, imM EGTA, 100 mM $MgCl_2$, 5 mM $MnCl_2$, 0.5 mg/ml BSA), then 5ul of Sodium Vanadate(1 mM), and then 5ul of water. Mix the components gently and preincubate the reaction mix at 30° C. for 2 min. Initial the reaction by adding 10µl of the control enzyme or the filtered supernatant.

The tyrosine kinase assay reaction is then terminated by adding 10 ul of 120 mm EDTA and place the reactions on ice.

Tyrosine kinase activity is determined by transferring 50 ul aliquot of reaction mixture to a microtiter plate (MTP) module and incubating at 37° C. for 20 min. This allows the streptavadin coated 96 well plate to associate with the biotinylated peptide. Wash the MTP module with 300 ul/well of PBS four times. Next add 75 ul of anti-phosphotyrosine antibody conjugated to horse radish peroxidase(anti-P-Tyr-POD(0.5 u/ml)) to each well and incubate at 37° C. for one hour. Wash the well as above.

Next add 100 ul of peroxidase substrate solution (Boehringer Mannheim) and incubate at room temperature for at least 5 mins (up to 30 min). Measure the absorbance of the sample at 405 nm by using ELISA reader. The level of bound peroxidase activity is quantitated using an ELISA reader and reflects the level of tyrosine kinase activity.

Example 20

High-Throughput Screening Assay Identifying Phosphorylation Activity

As a potential alternative and/or compliment to the assay of protein tyrosine kinase activity described in Example 19, an assay which detects activation (phosphorylation) of major intracellular signal transduction intermediates can also be used. For example, as described below one particular assay can detect tyrosine phosphorylation of the Erk-1 and Erk-2 kinases. However, phosphorylation of other molecules, such as Raf, JNK, p38 MAP, Map kinase kinase (MEK), MEK kinase, Src, Muscle specific kinase (MuSK), IRAK, Tec, and Janus, as well as any other phosphoserine, phosphotyrosine, or phosphothreonine molecule, can be detected by substituting these molecules for Erk-1 or Erk-2 in the following assay.

Specifically, assay plates are made by coating the wells of a 96-well ELISA plate with 0.1 ml of protein G (1 ug/ml) for 2 hr at room temp, (RT). The plates are then rinsed with PBS and blocked with 3% BSA/PBS for 1 hr at RT. The protein G plates are then treated with 2 commercial monoclonal antibodies (100 ng/well) against Erk-1 and Erk-2 (1 hr at RT) (Santa Cruz Biotechnology). (To detect other molecules, this step can easily be modified by substituting a monoclonal antibody detecting any of the above described molecules.) After 3–5 rinses with PBS, the plates are stored at 4° C. until use.

A431 cells are seeded at 20,000/well in a 96-well Loprodyne filterplate and cultured overnight in growth medium. The cells are then starved for 48 hr in basal medium (DMEM) and then treated with EGF (6 ng/well) or 50 ul of the supernatants obtained in Example 11 for 5–20 minutes. The cells are then solubilized and extracts filtered directly into the assay plate.

After incubation with the extract for 1 hr at RT, the wells are again rinsed. As a positive control, a commercial preparation of MAP kinase (10 ng/well) is used in place of A431 extract. Plates are then treated with a commercial polyclonal (rabbit) antibody (1 ug/ml) which specifically recognizes the phosphorylated epitope of the Erk-1 and Erk-2 kinases (1 hr at RT). This antibody is biotinylated by standard procedures. The bound polyclonal antibody is then quantitated by successive incubations with Europium-streptavidin and Europium fluorescence enhancing reagent in the Wallac DELFIA instrument (time-resolved fluorescence). An increased fluorescent signal over background indicates a phosphorylation.

Example 21

Method of Determining Alterations in a Gene Corresponding to a Polynucleotide

RNA isolated from entire families or individual patients presenting with a phenotype of interest (such as a disease) is be isolated. cDNA is then generated from these RNA samples using protocols known in the art. (See, Sambrook.) The cDNA is then used as a template for PCR, employing primers surrounding regions of interest in SEQ ID NO:X. Suggested PCR conditions consist of 35 cycles at 95° C. for 30 seconds; 60–120 seconds at 70° C., using buffer solutions described in Sidransky, D., et al., Science 252:706 (1991).

PCR products are then sequenced using primers labeled at their 5' end with T4 polynucleotide kinase, employing SequiTherm Polymerase. (Epicentre Technologies). The intron-exon borders of selected exons is also determined and genomic PCR products analyzed to confirm the results. PCR products harboring suspected mutations is then cloned and sequenced to validate the results of the direct sequencing.

PCR products is cloned into T-tailed vectors as described in Holton, T. A. and Graham, M. W., Nucleic Acids Research, 19:1156 (1991) and sequenced with T7 polymerase (United States Biochemical). Affected individuals are identified by mutations not present in unaffected individuals.

Genomic rearrangements are also observed as a method of determining alterations in a gene corresponding to a polynucleotide. Genomic clones isolated according to Example 2 are nick-translated with digoxigenindeoxy-uridine 5'-triphosphate (Boehringer Manheim), and FISH performed as described in Johnson, Cg. et al., Methods Cell Biol. 35:73–99 (1991). Hybridization with the labeled probe is carried out using a vast excess of human cot-1 DNA for specific hybridization to the corresponding genomic locus.

Chromosomes are counterstained with 4,6-diarnino-2-phenylidole and propidium iodide, producing a combination of C- and R-bands. Aligned images for precise mapping are obtained using a triple-band filter set (Chroma Technology, Brattleboro, Vt.) in combination with a cooled charge-coupled device camera (Photometrics, Tucson, Ariz.) and variable excitation wavelength filters. (Johnson, Cv. et al., Genet. Anal. Tech. Appl., 8:75 (1991).) Image collection, analysis and chromosomal fractional length measurements are performed using the ISee Graphical Program System. (Inovision Corporation, Durham, N.C.) Chromosome alterations of the genomic region hybridized by the probe are identified as insertions, deletions, and translocations. These alterations are used as a diagnostic marker for an associated disease.

Example 22

Method of Detecting Abnormal Levels of a Polypeptide in a Biological Sample

A polypeptide of the present invention can be detected in a biological sample, and if an increased or decreased level of the polypeptide is detected, this polypeptide is a marker for a particular phenotype. Methods of detection are numerous, and thus, it is understood that one skilled in the art can modify the following assay to fit their particular needs.

For example, antibody-sandwich ELISAs are used to detect polypeptides in a sample, preferably a biological sample. Wells of a microtiter plate are coated with specific antibodies, at a final concentration of 0.2 to 10 ug/ml. The antibodies are either monoclonal or polyclonal and are produced by the method described in Example 10. The wells are blocked so that non-specific binding of the polypeptide to the well is reduced.

The coated wells are then incubated for >2 hours at RT with a sample containing the polypeptide. Preferably, serial dilutions of the sample should be used to validate results. The plates are then washed three times with deionized or distilled water to remove unbounded polypeptide.

Next, 50 ul of specific antibody-alkaline phosphatase conjugate, at a concentration of 25–400 ng, is added and incubated for 2 hours at room temperature. The plates are again washed three times with deionized or distilled water to remove unbounded conjugate.

Add 75 ul of 4-methylumbelliferyl phosphate (MUP) or p-nitrophenyl phosphate (NPP) substrate solution to each well and incubate 1 hour at room temperature. Measure the reaction by a microtiter plate reader. Prepare a standard curve, using serial dilutions of a control sample, and plot polypeptide concentration on the X-axis (log scale) and fluorescence or absorbance of the Y-axis (linear scale). Interpolate the concentration of the polypeptide in the sample using the standard curve.

Example 23

Formulating a Polypeptide

The secreted polypeptide composition will be formulated and dosed in a fashion consistent with good medical practice, taking into account the clinical condition of the individual patient (especially the side effects of treatment with the secreted polypeptide alone), the site of delivery, the method of administration, the scheduling of administration, and other factors known to practitioners. The "effective amount" for purposes herein is thus determined by such considerations.

As a general proposition, the total pharmaceutically effective amount of secreted polypeptide administered parenterally per dose will be in the range of about 1 $\mu$g/kg/day to 10 mg/kg/day of patient body weight, although, as noted above, this will be subject to therapeutic discretion. More preferably, this dose is at least 0.01 mg/kg/day, and most preferably for humans between about 0.01 and 1 mg/kg/day for the hormone. If given continuously, the secreted polypeptide is typically administered at a dose rate of about 1 $\mu$g/kg/hour to about 50 $\mu$g/kg/hour, either by 1–4 injections per day or by continuous subcutaneous infusions, for example, using a mini-pump. An intravenous bag solution may also be employed. The length of treatment needed to observe changes and the interval following treatment for responses to occur appears to vary depending on the desired effect.

Pharmaceutical compositions containing the secreted protein of the invention are administered orally, rectally, parenterally, intracistemally, intravaginally, intraperitoneally, topically (as by powders, ointments, gels, drops or transdermal patch), bucally, or as an oral or nasal spray. "Pharmaceutically acceptable carrier" refers to a non-toxic solid, semisolid or liquid filler, diluent, encapsulating material or formulation auxiliary of any type. The term "parenteral" as used herein refers to modes of administration which include intravenous, intramuscular, intraperitoneal, intrasternal, subcutaneous and intraarticular injection and infusion.

The secreted polypeptide is also suitably administered by sustained-release systems. Suitable examples of sustained-release compositions include semi-permeable polymer matrices in the form of shaped articles, e.g. films, or mirocapsules. Sustained-release matrices include polylactides (U.S. Pat. No. 3,773,919, EP 58,481), copolymers of L-glutamic acid and gamma-ethyl-L-glutamate (Sidman, U. et al., Biopolymers 22:547–556 (1983)), poly (2-hydroxyethyl methacrylate) (R. Langer et al., J. Biomed. Mater. Res. 15:167-277 (1981), and R. Langer, Chem. Tech. 12:98–105 (1982)), ethylene vinyl acetate (R. Langer et al.) or poly-D-(−)-3-hydroxybutyric acid (EP 133,988). Sustained-release compositions also include liposomally entrapped polypeptides. Liposomes containing the secreted polypeptide are prepared by methods known per se: DE 3,218,121; Epstein et al., Proc. Natl. Acad. Sci. USA 82:3688–3692 (1985); Hwang et al., Proc. Natl. Acad. Sci. USA 77:4030–4034 (1980); EP 52,322; EP 36,676; EP 88,046; EP 143,949; EP 142,641; Japanese Pat. Appl. 83-118008; U.S. Pat. Nos. 4,485,045 and 4,544,545; and EP 102,324. Ordinarily, the liposomes are of the small (about 200–800 Angstroms) unilamellar type in which the lipid content is greater than about 30 mol. percent cholesterol, the selected proportion being adjusted for the optimal secreted polypeptide therapy.

For parenteral administration, in one embodiment, the secreted polypeptide is formulated generally by mixing it at the desired degree of purity, in a unit dosage injectable form (solution, suspension, or emulsion), with a pharmaceutically acceptable carrier, i.e., one that is non-toxic to recipients at the dosages and concentrations employed and is compatible with other ingredients of the formulation. For example, the formulation preferably does not include oxidizing agents and other compounds that are known to be deleterious to polypeptides.

Generally, the formulations are prepared by contacting the polypeptide uniformly and intimately with liquid carriers or finely divided solid carriers or both. Then, if necessary, the product is shaped into the desired formulation. Preferably the carrier is a parenteral carrier, more preferably a solution that is isotonic with the blood of the recipient. Examples of such carrier vehicles include water, saline, Ringer's solution, and dextrose solution. Non-aqueous vehicles such as fixed oils and ethyl oleate are also useful herein, as well as liposomes.

The carrier suitably contains minor amounts of additives such as substances that enhance isotonicity and chemical stability. Such materials are non-toxic to recipients at the dosages and concentrations employed, and include buffers such as phosphate, citrate, succinate, acetic acid, and other organic acids or their salts; antioxidants such as ascorbic acid; low molecular weight (less than about ten residues) polypeptides, e.g. polyarginine or tripeptides; proteins, such as serum albumin, gelatin, or immunoglobulins; hydrophilic polymers such as polyvinylpyrrolidone; amino acids, such as glycine, glutamic acid, aspartic acid, or arginine; monosaccharides, disaccharides, and other carbohydrates including cellulose or its derivatives, glucose, manose, or dextrins; chelating agents such as EDTA; sugar alcohols such as mannitol or sorbitol; counterions such as sodium; and/or nonionic surfactants such as polysorbates, poloxamers, or PEG.

The secreted polypeptide is typically formulated in such vehicles at a concentration of about 0.1 mg/ml to 100 mg/ml, preferably 1–10 mg/ml, at a pH of about 3 to 8. It will be understood that the use of certain of the foregoing excipients, carriers, or stabilizers will result in the formation of polypeptide salts.

Any polypeptide to be used for therapeutic administration can be sterile. Sterility is readily accomplished by filtration through sterile filtration membranes (e.g. 0.2 micron membranes). Therapeutic polypeptide compositions generally are placed into a container having a sterile access port, for example, an intravenous solution bag or vial having a stopper pierceable by a hypodermic injection needle.

Polypeptides ordinarily will be stored in unit or multi-dose containers, for example, sealed ampoules or vials, as an aqueous solution or as a lyophilized formulation for reconstitution. As an example of a lyophilized formulation, 10-ml vials are filled with 5 ml of sterile-filtered 1% (w/v) aqueous polypeptide solution, and the resulting mixture is lyophilized. The infusion solution is prepared by reconstituting the lyophilized polypeptide using bacteriostatic Water-for-Injection.

The invention also provides a pharmaceutical pack or kit comprising one or more containers filled with one or more of the ingredients of the pharmaceutical compositions of the invention. Associated with such container(s) can be a notice in the form prescribed by a governmental agency regulating the manufacture, use or sale of pharmaceuticals or biological products, which notice reflects approval by the agency of manufacture, use or sale for human administration. In addition, the polypeptides of the present invention may be employed in conjunction with other therapeutic compounds.

Example 24

Method of Treating Decreased Levels of the Polypeptide

It will be appreciated that conditions caused by a decrease in the standard or normal expression level of a secreted protein in an individual can be treated by administering the polypeptide of the present invention, preferably in the secreted form. Thus, the invention also provides a method of treatment of an individual in need of an increased level of the polypeptide comprising administering to such an individual a pharmaceutical composition comprising an amount of the polypeptide to increase the activity level of the polypeptide in such an individual.

For example, a patient with decreased levels of a polypeptide receives a daily dose 0.1–100 ug/kg of the polypeptide for six consecutive days. Preferably, the polypeptide is in the secreted form. The exact details of the dosing scheme, based on administration and formulation, are provided in Example 23.

Example 25

Method of Treating Increased Levels of the Polypeptide

Antisense technology is used to inhibit production of a polypeptide of the present invention. This technology is one example of a method of decreasing levels of a polypeptide, preferably a secreted form, due to a variety of etiologies, such as cancer.

For example, a patient diagnosed with abnormally increased levels of a polypeptide is administered intravenously antisense polynucleotides at 0.5, 1.0, 1.5, 2.0 and 3.0 mg/kg day for 21 days. This treatment is repeated after a 7-day rest period if the treatment was well tolerated. The formulation of the antisense polynucleotide is provided in Example 23.

Example 26

Method of Treatment Using Gene Therapy

One method of gene therapy transplants fibroblasts, which are capable of expressing a polypeptide, onto a patient. Generally, fibroblasts are obtained from a subject by skin biopsy. The resulting tissue is placed in tissue-culture medium and separated into small pieces. Small chunks of the tissue are placed on a wet surface of a tissue culture flask, approximately ten pieces are placed in each flask. The flask is turned upside down, closed tight and left at room temperature over night. After 24 hours at room temperature, the flask is inverted and the chunks of tissue remain fixed to the bottom of the flask and fresh media (e.g. Ham's F12 media, with 10% FBS, penicillin and streptomycin) is added. The flasks are then incubated at 37° C. for approximately one week.

At this time, fresh media is added and subsequently changed every several days. After an additional two weeks in culture, a monolayer of fibroblasts emerge. The monolayer is trypsinized and scaled into larger flasks.

pMV-7 (Kirschmeier, P.T. et al., DNA, 7:219–25 (1988)), flanked by the long terminal repeats of the Moloney murine sarcoma virus, is digested with EcoRI and HindIII and subsequently treated with calf intestinal phosphatase. The linear vector is fractionated on agarose gel and purified, using glass beads.

The cDNA encoding a polypeptide of the present invention can be amplified using PCR primers which correspond to the 5' and 3' end sequences respectively as set forth in Example 1. Preferably, the 5' primer contains an EcoRI site and the 3' primer includes a HindIII site. Equal quantities of the Moloney murine sarcoma virus linear backbone and the amplified EcoRI and HindIII fragment are added together, in the presence of T4 DNA ligase. The resulting mixture is maintained under conditions appropriate for ligation of the two fragments. The ligation mixture is then used to transform bacteria HB 101, which are then plated onto agar containing kanamycin for the purpose of confirming that the vector has the gene of interest properly inserted.

The amphotropic pA317 or GP+am12 packaging cells are grown in tissue culture to confluent density in Dulbecco's Modified Eagles Medium (DMEM) with 10% calf serum (CS), penicillin and streptomycin. The MSV vector containing the gene is then added to the media and the packaging cells transduced with the vector. The packaging cells now produce infectious viral particles containing the gene (the packaging cells are now referred to as producer cells).

Fresh media is added to the transduced producer cells, and subsequently, the media is harvested from a 10 cm plate of confluent producer cells. The spent media, containing the infectious viral particles, is filtered through a millipore filter to remove detached producer cells and this media is then used to infect fibroblast cells. Media is removed from a sub-confluent plate of fibroblasts and quickly replaced with the media from the producer cells. This media is removed and replaced with fresh media. If the titer of virus is high, then virtually all fibroblasts will be infected and no selection is required. If the titer is very low, then it is necessary to use a retroviral vector that has a selectable marker, such as neo or his. Once the fibroblasts have been efficiently infected, the fibroblasts are analyzed to determine whether protein is produced.

The engineered fibroblasts are then transplanted onto the host, either alone or after having been grown to confluence on cytodex 3 microcarrier beads.

It will be clear that the invention may be practiced otherwise than as particularly described in the foregoing description and examples. Numerous modifications and variations of the present invention are possible in light of the above teachings and, therefore, are within the scope of the appended claims.

The entire disclosure of each document cited (including patents, patent applications, journal articles, abstracts, laboratory manuals, books, or other disclosures) in the Background of the Invention, Detailed Description, and

SEQUENCE LISTING (757 sequences)

SEQ ID NO: 1 - DNA, 733 bp, Homo sapiens
gggatccggagcccaaatcttctgacaaaactcacacatgcccaccgtgcccagcacctgaattcgagggtgcaccgtcagtcttcctcttccccccaaaacccaaggacaccctcatgatctcccggactcctgaggtcacatgcgtggtggtggacgtaagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccaacccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagtgcgacggccgcgactctagaggat

SEQ ID NO: 2 - protein, 5 aa, Homo sapiens
  Site (3): Xaa equals any of the twenty naturally ocurring L-amino acids
WSXWS

SEQ ID NO: 3 - DNA, 86 bp, Homo sapiens
gcgcctcgagatttccccgaaatctagatttccccgaaatgatttccccgaaatgatttccccgaaatatctgccatctcaattag

SEQ ID NO: 4 - DNA, 27 bp, Homo sapiens
gcggcaagctttttgcaaagcctaggc

SEQ ID NO: 5 - DNA, 271 bp, Homo sapiens
ctcgagatttccccgaaatctagatttccccgaaatgatttccccgaaatgatttccccgaaatatctgccatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctt

SEQ ID NO: 6 - DNA, 32 bp, Homo sapiens
gcgctcgagggatgacagcgatagaaccccgg

SEQ ID NO: 7 - DNA, 31 bp, Homo sapiens
gcgaagcttcgcgactccccggatccgcctc

SEQ ID NO: 8 - DNA, 12 bp, Homo sapiens
ggggactttccc

SEQ ID NO: 9 - DNA, 73 bp, Homo sapiens
gcggcctcgaggggactttcccggggactttccggggactttccgggactttccatcctgccatctcaattag

SEQ ID NO: 10 - DNA, 256 bp, Homo sapiens
ctcgaggggactttcccggggactttccggggactttccgggactttccatctgccatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctt

SEQ ID NO: 11 - DNA, 1019 bp, Homo sapiens
  SITE (88): n equals a,t,g, or c
  SITE (89): n equals a,t,g, or c
  SITE (109): n equals a,t,g, or c
  SITE (977): n equals a,t,g, or c
  SITE (989): n equals a,t,g, or c
  SITE (994): n equals a,t,g, or c
atggtgtgcctggatggtcgtgtaggtgagttttaccaaggattatggtaacaaatgagtgagacctctatggagaaaatattgaagnncattaaagaagacctcatantaggagagaatgtsctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaatatactgtttatctgtttctgaatggggactgaactttttggatattgatattgatttgaaaatattttggaatttttctactgaaattttagaaatctaatkgaaaattctataagtactgaaagtawggttgtgtacagtgakcactctctaataatatgatgncttgccctaaangaggngggacatgtcccactttccaccacg

SEQ ID NO: 12 - DNA, 465 bp, Homo sapiens
gtttgggggtgaggccgagctgctgcggggcttcgtcgccggccaggacacagctactcgcacggcggcggcgcctggctatgatgttcctcacccagggcgggcctctgccctctactcgtgccaggcccacttgccaggcaggagccctccccaagccttcagggctgctcggagtcacctgttggaatggactaaaaggacccttgtgtgggaacaggtgctccccaaacaccctgctgctggctgccaggcaggccctctggaagggaaggggcaggactcatcaggacctccctggacccctgcagggcaggcagcttgggcccgagcccaagcatttggctctgctgcccccaaggggacaggaagcctcttgggcctcttcccttcctggacaaggccccctgcctttgcctcacataaactgtacagtattttcattaaaagcctctttcataaaaa

SEQ ID NO: 13 - DNA, 474 bp, Homo sapiens
atgcaattcctgctcacagcctttctgttggtgccacttctggctctttgtgatgtccccatatccctaggcttctccccctcctagaagggcttcttgatagattagaaaataagaatgagtgacatttcctatgtgcatataagaaggagccacaagacatgtcttttaaataaaaggacagtgtccatccttttagctgccgaatagaaccttggtctcatcctcctggagctaggcctttaaaacagcttctgtgtttctcatttgtctcagtgttttgccagggttttatcggaaagataatgttccgtttaaaatatttcctaatgaggccgggcgtggtggctcacgcctgtaaccctagcamttgggggctgagcgggtggatcacgaggtcaggagatcgagaccatcctggstaacatggtgaaaccccgtctctactaaaaatacaaaaaaaaaaaaaaaaaa

SEQ ID NO: 14 - DNA, 314 bp, Homo sapiens
  SITE (249): n equals a,t,g, or c
  SITE (308): n equals a,t,g, or c
ttatgttggggagcaagacctgatagccagcctttacatgggagtataattctgtcctccatctcataagccccagtacctgagccagaatgattataaccaaccacactgtctctttatcatggatggctttagcagtaggttattttcatcattgccatttgtagctctacagtggtttatagtaatttctcatcttttaagtctctccctcagtgcctgttgttatcaaactcattgctctctcangcagttgagctctgcattctcccytatgggggagagctgtgttggagagagagaatatnacttcc

SEQ ID NO: 15 - DNA, 613 bp, Homo sapiens
ctcatattgccgtctggctaaaagtgaacatgccattgatcaatctgcttttattatattatgttcctaatggtggcaagcaagacaagaagtagaaagaaagatggtgtaagctcaagaacccactaaatctatcctatggcctgggttcacccagcctgctttgtggattttgtctcactataacagagctcccaaggagactgcagagtcagctcccttaagcactgtaactaaagcctaactcttccgttccacccaacaatgtycccagctcatcctctttcccraagtcccctttctgccccagatgcgaattgcatttaactaatcctcaagtgaaatgtccacacagrattccattttaattagcataccatagtttttgtgcaaatttgctttcagargactcccattgcagctgctcagagacgctaawggcagggcctcttgawgctttcccgatagctttcagctgcaatagctcttaggcagaatgccatgagcgtcctgcccaactgtattactggggaacacctgattggctagaagttgatcctcctgtaacttttctgagttctttacatttactcgtgaaacccaaatatgccac

SEQ ID NO: 16 - DNA, 356 bp, Homo sapiens
ccccccccattgaaccctgggctgtgaaagtttttgcctgtgtgggtcgttctgtgtggcgcctggtgtgtggktcccaactcctgttgcaaagtggcagcagccaatcatgaagcgcccttatttttagttgcagatgaccaggtctcccccccacagcctctgtctggtccctcattggtgagtggtctgcctgcccaaggagcctgattggtgggaaatggcatcatctaatatgatgggaaggcatttggtcctggttatgtttattacaacatcattgcactctgggactccagtccctgaaaacgtaatttgtggtgttaccaaaggaccacaggggaaaaaaaaaaaaa

SEQ ID NO: 17 - DNA, 414 bp, Homo sapiens
  SITE (8): n equals a,t,g, or c
  SITE (26): n equals a,t,g, or c
  SITE (62): n equals a,t,g, or c
gaaactanatcccggggcttttaacnggtacttgggaaataagtattgggtaatcactaagnggacattgactgcaccaaaccaaagctatagaaagaaatgattgactttttaaaatatattcacattaactgtcctaggatacttctcttgaggctttggaaaacttcttccttgaaatttgcatatccactccagttctgtcaccaaagattttaatcttcagatcgcaatttcctctctcccagaaaaaagtactacaacaggctcaagggatatgctttggtggtcaagggattacactatggttttccttctgttcacaatggtatttacaggagaccttgtcatcagaggacgtactgaactatctttatgactttggatttgatcagaggtttaaaaaaaaaaaaa

SEQ ID NO: 18 - DNA, 469 bp, Homo sapiens
aatcaccattgcaatacaaatgatctgcctggtgaatgytgagctgtaccccacattcgtcaggaacytcggagtgatggtgtgttcctccctgtgtgacataggtgggataatcacccccttcatagtcttcaggctgagggaggtctggcaagccttgcccctcattttgtttgcggtgttgggcctgcttgccgcgggagtgacgctacttcttccagagaccaagggggtcgctttgccagagaccatgaaggacgccgagaaccttgggagaaaagcaaagcccaaagaaaacacgatttaccttaaggtccaaacctcagaaccctcgggcacctgagagagatgttttgcggcgatgtcgtgttggagggatgaagatggagttatcctctgcagaaattcctagacgccttcacttctctgtattcttcctcatacttgcctacccccaaattaatatcag

SEQ ID NO: 19 - DNA, 550 bp, Homo sapiens
cccccccccccccccacactttcaggagtcaccccccagcatttggggttgggttggccctactccagcctggagctccctgagggagcctgcactccctgctcccaatccccgctactggtgcagggatgcagcctggagctggcgtccttgttctgggcctgctgctgccgccaccccagagccccagcctgtcctgaattgacatcagtgcttccctgaactgcctcccccacccctgggcattatcccaggaaactttatgttttctagaagctaagcagctgctgggactcagggactggtgcaggtaggctgagtggcagctcagtcctagaaggtctctgaagatctggactgaggaccttgctactccccaagccagagcccatcagccaggcctgctgtgagccacctgcctgtggagtgctgagctcaaccaaaggctggcaagctctgggcctcatttaagggattctgatgagccgatgggccctggaggcagcccattaaagcatctggctcgtttttggaaaaaaaaaaaaaaaaa

SEQ ID NO: 20 - DNA, 773 bp, Homo sapiens
agtacaggattattataatgaaagtttatatcaacagggtttcgttggctctgccatatattataagcaaaagagattggtaaagtgccacagtattccagataacttttcagttgcggcctttcttctcgttctttaatttgaaacctagatacatgcagtaaaaactaggagaatgacttttacccttggggacagccaagttttgttgataaacctatttcctagcatgccttcaggaagttgtgccagaccctagattgtgaagaccactgttcttctgttgtacgagctccctgaaccattgttcagagaccaatgtcacatcgcttcatgggcatggccatgggagcatctgggtgatatctgtctacagtattggctcttctgcgaggctgatacacaaggctctcttccacatgatcatttgcaaacctcccccagccctaccatccaatgtggaaggaaaacaagaactgcctgaagaagagtccaagctacagatacacagcgtgtgcattgcggctgtcaccttcctcctcccacttctgtatcctcagagatgctgcgtggatgtttccttaacctcagctgacttccctgtgaatgtctaatgctagttcagggcctccaggcattgatttgtacagtggtaactcccaatgaggcttctgttatcatttggtgtgctttttctgtcattaaaagaaatgattttcccaaaaaaaaaaaaaaaaaaaaaaaaaaaaaaaaaaaaaaaaaaaaaaaaaaaa

SEQ ID NO: 21 - DNA, 991 bp, Homo sapiens
ggcacgagtctcccctggggaagtttttctttttcaggagggaggagggctttcccaggtaatgtgtctagagtgttgggcagaaaatctgggaccacaccacaccagttctctccttaatccacgtcatttgccttctatcccagctatgtttccagtgtcctctgggtgtttccaagagcaacaagaaatgaataaatctctggtgagttgtttatttgttcttcactttgttttacactgtattttctgagtttatgggtgtctgtgaattaaaaaggaaaagtagaaataagtaaaactcaggttgaaggaaatatacataaataagataaagctgacctgtagatatagcaggttataaagcttagagttgtctaagttgagtgcaaattttcctctgatctttctgatgccgaacaaaaaagcagtcatgtttgttatgtgattggaatggaacccgagaagagagcatgctgtgttcttgtgggacaggaaagcttgcgtgcaccaagtctgaaccaccaccttcatggtgacatagattatgtgctggaacatatttcacaccggcctggcagtaaacacttgtagtgttgtgcagtggaaacggtcatcttccgctaaagcacggcgtgttgtgcagcggaaatggtcatctgctgctaaaacacagcttccatcgtaatgtatgctccttactcaaagagtgtggtcccaaacagcctttgggaggtcctccttgattcatggatgaaacctggaacatcttgaggactgagttaaccataggtccttaaataactctccacacgtttttcttagtttatctctacatgcagggtgtgcagcagcctgttcaaagtcatattttctgggaaatatttccagtgtttatttgcactttagcccactctgtgtagccttatttcttctaaactcaccattaatctgaataatagtcaaatttagggggactgtatttgcctta

SEQ ID NO: 22 - DNA, 653 bp, Homo sapiens
ccacgcgtccggaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagaagtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcggaggcatccaaaaaaaaaaaaaaa

SEQ ID NO: 23 - DNA, 1486 bp, Homo sapiens
  SITE (589): n equals a,t,g, or c
  SITE (602): n equals a,t,g, or c
  SITE (1484): n equals a,t,g, or c
  SITE (1485): n equals a,t,g, or c
  SITE (1486): n equals a,t,g, or c
ggcaggctgacgacctgcaagccacagtggctgccctgtgcgtgctgcgaggtgggggaccctgggcaggaagctggctgagccccaagaccccgggggccatgggcggggatctggtgcttggcctgggggccttgagacgccgaaagcgcttgctggagcaggagaagtctctrgccggctgggcactggtgctggcasgarctggcattggactcatggtgctgcatgcagagatgctgtggttcggggggtgctcggctgtcaatgccactgggcacctttcagacacactttggctgatccccatcacattcctgaccatcggctatggtgacgtggtgccgggcaccatgtggggcaagatcgtytgcctgtgcactggagtcatgggtgtctgctgcacagccctgctggtggccgtggtggcccggaagctggagtttaacaaggcagagaagcacgtgcacaacttcatgatggatatccagtataccaaagagatgaaggagtccgctgcccgagtgctacaagaagcctggatgttctacaaacatactcgcaggaaggagtctcatgctgcccgcangcatcagcgcaanctgctggccgccatcaacgcgttccgccaggtgcggctgaaacaccggaagctccgggaacaagtgaactccatggtggacatctccaagatgcacatgatcctgtatgacctgcagcagaatctgagcagctcacaccgggccctggagaaacagattgacacgctggcggggaagctggatgccctgactgagctgcttagcactgccctggggccgaggcagcttccagaacccagccagcagtccaagtagctggacccacgaggaggaaccaggctactttccccagtactgaggtggtggacatcgtctctgccactcctgacccagccctgaacaaagcacctcaagtgcaaggaccaaagggggccctggcttggagtgggttggcttgctgatggctgctggaggggacgctggctaaagtgggkaggccttggcccacctgaggccccaggtgggaacatggtcacccccactctgcataccctcatcaaaaacactctcactatgctgctatggacgacctccagctctcagttacaagtgcaggcgactggaggcaggactcctgggtccctgggaaagagggtactaggggcccggatccaggattctgggaggcttcagttaccgctggccgagctgaagaactgggtatgaggctggggcggggctggaggtggcgccccctggtgggacaacaaagaggacaccatttttccagagctgcagagagcacctggtggggaggaagaagtgtaactcaccagcctctgctcttatctttgtaataaatgttaaagccagaaaaaaataaaaaaaaaaaaaaaaaaactcgaggggggcccrkacccaatcwccctatagtakacgtannn

SEQ ID NO: 24 - DNA, 2323 bp, Homo sapiens
cttcgccgtttctcctgccaggggaggtcccggcttcccgtggaggctccggaccaagccccttcagcttctccctccggatcgatgtgctgccgccgccgccgccgccgtcccgcgtccttcggtctctgctcccgggacccggctccgcgcagccagccagcatgtcggggatcaagaagcaaaagacggagaaccagcagaaatccaccaatgtagtctatcaggcccaccatgtgagcaggaataagagagggcaagtggttggaacaaggggtgggttccgaggatgtaccgtgtggctaacaggtctctctggtgctgggaaaaacaacgataagttttgccctggaggagtacttgtctcccatgccatccctgttaattcctggatggggacaatgtccgtcatggccttaacagaatcccccagatggcttcatggcccccaaagcatggaaggtcctgacagattattacaggtccctgcagaagaactaagcctttggtccagagtttctttctgaagtgctctttgattaccttttctatttttatgattagatgctttgtattaaattgcttctcaatgatgcattttaatcttttataatgaagtaaaagttgtgtctataattaaaaaaatatatatatatatacacacacacatatacatacaaagtcaaactgaagaccaaatcttagcaggtaaaagcaatattcttatacatttcataataaaattagctctatgtattttctactgcacctgagcaggcaggtcccagatttcttaaggctttgtttgaccatgtgtctagttacttgctgaaaagtgaatatattttccagcatgtcttgacaacctgtactcttccaatgtcatttatcagttgtaaaatatatcagatgtgtcctcttctgtacaattgacaaaaaaaaaaatttttttttctcactctaaaagaggtgtggctcacatcaagattcttcctgatattttacctcatgctgtacaaagccttaatgttgtaatcatatcttacgtgttgaagacctgactggagaaacaaaatgtgcaataacgtgaattttatcttagagatctgtgcagcctatttctgtcacaaaagttatattgtctaataagagaagtcttaatggcctctgtgaataatgtaactccagttacacggtgacttttaatagcatacagtgatttgatgaaaggacgtcaaacaatgtggcgatgtcgtggaaagttatctttcccgctctttgctgtggtcattgtgtcttgcagaaaggatggccctgatgcagcagcagcgccagctgtaataaaaaataattcacactatcagactagcaaggcactagaactggaaaagaccacagaaaacaaagaatccaaccctttcatcttacaggtgaacaaactgtgatgatgcacatgtatgtgttttgtaagctgtgagcaccgtaacaaaatgtaaatttgccattattaggaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgattttattgcagttgaaaaaaaaaaaaagctattccaaagatttcaagctgttctgagacatcttctgatggctttacttcctgagaggcaatgtttttactttatgcataattcattgttgccaaggaataaagtgaagaaacagcaccttttaatatataggtctctctggaagagacctaaattagaaagagaaaactgtgacaattttcatattctcattcttaaaaaacactaatcttaactaacaaaagttcttttgagaataagttacacacaatggccacagcagtttgtctttaatagtatagtgcctatactcatgtaatcggttactcactactgcctttaaaaaaaaaaaccagcatatttattgaaaacatgagacaggattatagtgccttaaccgatatattttgtgacttaaaaaatacatttaaaactgctcttctgctctagtaccatgcttagtgcaaatgattatttctatgtacaactgatgcttgttcttattttaataaatttatcagagtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 25 - DNA, 683 bp, Homo sapiens
ggcacgagcctgtgtggtcatgttcctcgtggtgcagtacctgacatgagccagccacgctcagtggctgaacagcattcccacagcctgcaagtgtgtgtgtgtgtgaaagagagaggggggcccagagccgccttttgaaatgtttgcctgtctgaactgtgaagacacttgggagtgattgtggtctaatttccaacctgctctgttttctgtgacatcttggaggggagctagtgccacaccatgcgcggtgcttagaaatgaaaaagtcccgggtctgtctctctcactctcgctctcatgggggagggaaagaatggctttggtggctttgttcacacagctgatgcgtgctgggaaggtgtccacagtgagcctgtgtgcaggactgtccacacggttcacacttgtcaccatcaggcctttctggtcctgatagggtggagcaaaagtggaaaggaaaggaaagaggcttttctcacagccattatattaaatagtaggtcgattcacatctcgtgctcctggccaccttcccctgtgcctcagtgacatgtagatgactgactgccaatacttgtcaccattccctggaagcagctacctaggggaaacaagatgtagtgctattgccgataacaagtaagattttccacactaaaaaaaaaaaaaaaaaaaaa

SEQ ID NO: 26 - DNA, 2036 bp, Homo sapiens
  SITE (1599): n equals a,t,g, or c
  SITE (2028): n equals a,t,g, or c
  SITE (2032): n equals a,t,g, or c
  SITE (2033): n equals a,t,g, or c
ctgagaaaggaaagcattcggatctgctgcaaaaacacatatatccataaagactcatgttattcagaaaacagattgtgaacacaatcacattcgcatgaatcctttaaaaggaagaagaccttaaagtatctgcaaatctgaatttctatttattccttcactgaatatagaaacaatggttatctgattattagagatattattttggatatgttacttattaacttgctatggctggtaaccatgataaagtctgttattaataacaacataattctttttttaaagaagaaaagcttatttttcattgacagtgtatagatttatctacttagttgtgttttgctattagtgttttaattttttttttaagttgagtgtttgataaattttaagaccctgtccccaccttgttttgagtcctgtgttgactacaggtatatagcycawtttaaaaatcctaaagcaaaagaattttatttataaaagaatcmamcmgttgcatgcatgaggctgtgaagtcagatatttagtaataaaagcagcagtgcctttttttgtatttacccattgacccccaccaaatgcaactgttttatattaagaaaatagtaacaattttaaaatctcagagtaaaatctatttcactacatgcttttccccccttgttctgatttaagcagtgtgtacttggcatctctacattgtcctagggacagtggtgttctacaatattatcatgtatgatgttttattggtgctttttattcatagtggcttcttaccagaaacagtaggaagaaacacatgaactgtgtacaagacatgaaacattgctgctgatatgttgttttttcacatgcttttgagttttcactttttaaacgagagccagcaagcaaaatagatgtggctgggtctgcctgtccgggcggctytttgcaccgagctctcaaatcctgtgtattgagggttcctttttggtactcaggattggagctacagctgggcccccctctctcccattcgtttgaagagacactgagggaaacaagggtttcttttgaggtgtccttggctgccttttacgggatgggagccttctccggatcttttgttcttctgcacctcttgtagctactgccggtgcaaggttgtagatgttattccccaggagcctgggctkgggggctgagctgggctgaatgcaaaagcatgcaaccagaaggcgggcaaggggaggaaaagcaggcctggcctcattggtcccctggagatgtctgtagcagtcagctccagcttgggcctggggaagcagcctgaccaaggcgctcaggtgtgcctgttacaagaagaacctgcagaaggataatttgcacatggagctgtgataacactaatgttgattttttttttttttacaagtcatcagrgatgtttgcaaagtgagttttatttttttgtaattcctttatctttacttaaaggtgaatgtgtattcctctgggaggaataggaagaaaacaggaatgttaataatgtcgaacagaaaacttcctcccttattaatatataatcytcatgtatttatgccntaatgtaagctgacttttaaaaagctttcttttgttgcatgccctgtgcaggcatctgtattgtacatgcatgcctttcgtcctgttttcctgtataaagttagtgaacaaagaaatatttttgccctagttcatgttgccaagcaatgcatattttttaaatttgtcatatatggaaagagcatgtttgttacatgtaaaagctttactgatatacagatatactaatgtttgaagatgctgttctttgcaagtgtacagttttcaaatgttgttaccagtgaaacacccttgtggtttaaacttgctacaatgtatttattattcatttcctcccatgtaactaagaatcatggctatatttcatatcaacgttatattgaaagtgaagggaaatgattaatacaaggttttgtaacaaaaaaaaanaaannaaa

SEQ ID NO: 27 - DNA, 717 bp, Homo sapiens
ggcacgagataacataggcacaataatactgtatgtctacttctaggattataaggaattaacattgagatgacatttccatttgagaagaaaatagttgctttcagtgccttttatttgattcctggagagagcagactcgcaccaacattcaaccccagcgctgatatgacagtaatcctcagaggcagagcccagcacaaaacagcaatgctagaaagttacaattggaaagtttcctgccagcttcgggaatgacactgcaaagctgatgccagaaactgccagagtaattctcctcattactgctctacccacccactttcagctccccaaattaactagtgcagttgactaatcctctttacctttatcatttaggtgaggcattgcacaaaaactctcgactttgccatataagggctgtggttctctgtggtcctggataagaggcatcaccattatctggaaacatgcagtaaatgcagattcttcatcttctccccagacctcctgagttagaaattcacaagttctccaggtgatctcatacatgctaaagtttgagaaccattgagtaaagttaatgcattaagaagagattagatagggatggtggcgtatcttcctacagtttccctgttaacaagaaagtcagaggtcagttgatcagacattagattatttattgctaaaactaaaaaaaattaaaaaaaa

SEQ ID NO: 28 - DNA, 495 bp, Homo sapiens
gaattcggcacgagcagcatcctaattttagtttggagatgcattctaaaggatcttctctattgctttttctcccacaattaatcttgattctgcctgtctgtgcacatttgcatgaggaactgaactgttgttttcataggtaaatgagagactgagttttttcatttctgaagagaaagggcatttgctcctacaagctgaaaggcacccctgggtggctggggccctcgtgggagtttctgggggattgacccttacaacatgcagtggccctacagaaaaacctgcaactaaaaattattttttaaaaaggctcctccaggaaatgcatataagggctaatcacccagtattttgargcttcgaagargtaataramccctggagagagaaactgagacatgtaagagggtgggaatgactcagtggtggcacactatggagtcctgcccacaagtagcacacatcaacccactacacagaaatcctagg

SEQ ID NO: 29 - DNA, 556 bp, Homo sapiens
agcttaacgtcatgattcattaggggaatgcaaggcaaaaccatgatgagaatgcccctagacacctcttagaagagctgctagaaaggcagacagcaccaagcgcttaaatgagatgggggcactggtgcttcttctgtgcctactggtaggggtgcagcagagtggttcagtctgggacagttagctggacatcacgtggacccaacacacgcatttcctgggttacttaccaaggagaatagaaagcaggcagatctttacagcagctcttacctgwttgcaaaacaatggaaatgcccacatgtccacaaacaagtktgtggtctgcctgtgccatgaagcacagtgtggctgagcgtcaagagtccccacactcaaaggaggcagcagatacagggctgcacactgtgtgattccacacatgtgacattctggacacggacatgctggatggcaaaacgagcatcgggctgagaggactgctgagaaggggaacggggctgctgggatgtgggttgattgtagcagtagctcatggagatgtgacctcaaa

SEQ ID NO: 30 - DNA, 434 bp, Homo sapiens
  SITE (347): n equals a,t,g, or c
  SITE (363): n equals a,t,g, or c
ctaaatggtgactgtggctttgtcgagacaggccccaaatggtaggtgtgaacacaacatgcacagaatgaggagacatgcagagtgctgaaatactgtcctggacagatgtgttacatgactttcttttcagcttatttctgtggcctgcctttgaagatagagctttgttgatatttacattaaaccaaattgtataaytatgttccattctgacatgttatttagcaaargaaaaargagtaattctacatcagcatctttagtgcatgctaaaagattaaaaatgtcttttggggaacatgttttgtatacataaatgtttagatagaaatatttatagaatnctctatgtgagtattnatctccctatgtatatttatatctagatgtgtcaatctttgtattgatatgaaatgctatgaatagtgaga

SEQ ID NO: 31 - DNA, 715 bp, Homo sapiens
ccacgcgtccgatctcacagctccgacactattgcgagccatacacaacctggtgtcaggaaacgtactcccaaactaagcccaagatgcaaagtttggttcaatgggggttagacagctatgactatctccaaaatgcacctcctggattttttccgagacttggtgttattggttttgctggccttattggactccttttggctagaggttcaaaaataaagaagctagtgtatccgcctggtttcatgggattagctgcctccctctattatccacaacaagccatcgtgtttgcccaggtcagtggggagagattatatgactggggtttacgaggatatatagtcatagaagatttgtggaaggagaactttcaaaagccaggaaatgtgaagaattcacctggaactaagtagaaaactccatgctctgccatcttaatcagttataggtaaacattggaactccatagaataaatcagtatttctacagaaaaatggcatagaagtcagtattgaatgtattaaattggctttcttcttcaggaaaaactagaccagacctctgttatcttctgtgaaatcatcctacaagcaaactaacctggaatcccttcacctagagataatgtacaagccttagaactcctcattctcatgttgctatttatgtacctaattaaaacccaagttaaaaaaaaaaaaaaaaaaa

SEQ ID NO: 32 - DNA, 486 bp, Homo sapiens
  SITE (374): n equals a,t,g, or c
  SITE (422): n equals a,t,g, or c
  SITE (442): n equals a,t,g, or c
  SITE (474): n equals a,t,g, or c
gagccagtgccggcgaaaggggaccttcctctacttcctgccacagaccctgtccccacacacttcctgcccctgctctgctgggaggccacttcctcccccagtgctggattccacccccagctcaccctcaaacatggccccctctctcctcctgcttgcccctctctgctccctggaggctgttctgtcctcccctcttgaaaagcaatgccagcttcctgggatcttctgccaactccagctaccatgccctttgctcctgtcagctcagctcctcaagggaattgtctamcctcggtgtcctgcttccctccctcaacctcctcaccctgctccaagctggcatctgcccctccactgcacagaacggntcccccaccacctgcctttacagggaggaagcagcaacatggaagaancgaactataggggctacaangatgctcagctctgatcccgaaggcaaaaagnatctttgggcac

SEQ ID NO: 33 - DNA, 725 bp, Homo sapiens
gttcctctggtaataattaggttattcccagaagcacagtgtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttctgcttataaaaaaaaaaaaaaaaaaa

SEQ ID NO: 34 - DNA, 437 bp, Homo sapiens
  SITE (410): n equals a,t,g, or c
  SITE (415): n equals a,t,g, or c
  SITE (436): n equals a,t,g, or c
cacacagcatgctgccctcagacgtgtccatcctgtaccacatgaaaacgctgctgctcctgcaagatactgagagattgaagcatgctctggaaatgttcccagaacattgcacgatgcctcctgcttttattggctcttgtcgaaatcaaattggaagatcttcagtcccagctgcacccaacgtggaaaagtattccaggtccatccccaaggaaccaacaccgatgacatggactcaggaatcttataacctacgtggactctttccatccgtacattgtcgtgcacatgccactcatcacctggcgtgcccagatcctcgcarggcaacaccctgtgataattccaggtgattctctacatctgcagcttgaggttagcctcatatcacattacattctcactanaaacnaaaaaaaaaaaaaaaaactcna

SEQ ID NO: 35 - DNA, 943 bp, Homo sapiens
  SITE (324): n equals a,t,g, or c
  SITE (333): n equals a,t,g, or c
  SITE (347): n equals a,t,g, or c
  SITE (354): n equals a,t,g, or c
  SITE (563): n equals a,t,g, or c
  SITE (584): n equals a,t,g, or c
  SITE (606): n equals a,t,g, or c
  SITE (628): n equals a,t,g, or c
  SITE (630): n equals a,t,g, or c
  SITE (637): n equals a,t,g, or c
  SITE (640): n equals a,t,g, or c
  SITE (652): n equals a,t,g, or c
  SITE (655): n equals a,t,g, or c
  SITE (673): n equals a,t,g, or c
  SITE (692): n equals a,t,g, or c
  SITE (708): n equals a,t,g, or c
  SITE (713): n equals a,t,g, or c
  SITE (721): n equals a,t,g, or c
  SITE (728): n equals a,t,g, or c
  SITE (735): n equals a,t,g, or c
  SITE (739): n equals a,t,g, or c
  SITE (769): n equals a,t,g, or c
  SITE (775): n equals a,t,g, or c
  SITE (799): n equals a,t,g, or c
  SITE (804): n equals a,t,g, or c
  SITE (812): n equals a,t,g, or c
  SITE (826): n equals a,t,g, or c
  SITE (838): n equals a,t,g, or c
  SITE (846): n equals a,t,g, or c
  SITE (884): n equals a,t,g, or c
  SITE (900): n equals a,t,g, or c
  SITE (901): n equals a,t,g, or c
ggcacgagctggaacagagactaaatcccacgaaactgacattgttaaacacactaaaacagaagtacttacctcttgaagatttaatatataatggttgacatgatacatgtacatgatgaatgaccagatgcttatggtctacattttcctttatcctgttagtattaccttccttaatctttgttcattaacatgctaattcctcttcagtgtttattttctagtgacagaatgctaacatttcttacaccctggcagaagggagagaaatgtgttttggggtgggtaactaaatttttgagtgaaatatcataagatganaatggaaanaaggagacacaaanagttatnacaaaaaaacaatggtttttttagccatttgactggctctttaaatagtctacaagacattcacgtttaacatcacttttagtgaaataaaatgtgccatactagtatgtgcttcaaaagggcaaatgtgctttagtgccctaaggctaaattttggtcatttgacatcagagatgttgtaagtattgcacttaatacgcacctatttntcaatagtgttattttttggntagcattttttttaccactatnttgttgatagctttttgttctntnaggttgnaanatgacagtgctnatntcaaacagattacccatntgcagaactaagggaagcnatttatgtatgaaagnaattnttgaattngtcattntcaaccnttgnattaaagcttagactaaatagtaatatatngtgggnaggattttggttttgtgatatttntgtgnattaaggnatagatgttaaccnttattttgtagnaaagtganttgtatgtggttaattataaataaaactggtaccaggnaaaaaaaaaaaaaaannaaaaaaaaaaaaaaaaaaaaaaaaaaaaaaaaaaaaaaaaaa

SEQ ID NO: 36 - DNA, 604 bp, Homo sapiens
ggcacgagaaatcttcatgctgtagtcactccagaccatggagtggctttccagctgaatgaatcctatgtctcgcgtgcaggtggttggttttcaatgttcttgctaattttttttctattggatcttgggagttttctttgtttgctcctgtgtttgcccagctttaataaaaccaggcgcaaacaaaaaccatagcattctgaacaatagggggcccacattggacccagtatgtcactttaatggacttcaagaaaaaatctgaatgggaaaaatgacactaggaatgtatactccacacattttatgccatataatggtgtgttttcttaattttgtttcttgtggcgaaatgtggctttcaaattaaaatgaccttttcttctttgaaactttttgttttgacttgtataattaagggtttggaaagattcataattctgagagaggtttgcaaccaggagatacaaagaagtctcagtagtaatcttgttcatgtgcttttacagccagctacatttaaggatgtattagttacagaaattatatgtctgtgtatgtgtctctactcaataaagtacatgcctccacaaaaaaaaaa

SEQ ID NO: 37 - DNA, 349 bp, Homo sapiens
  SITE (328): n equals a,t,g, or c
gtgagtgcccgggagccccgaggccctgcccctaagaaggatatctytraccgctcccttgtccacaccctaaccccccagctgctcaggcagtgggcacatggcaggggcctcactgggggcacatagagcatttgggggactgcgagtgctcacctttgacttcctgcaggtcgggggaaaaccagatcatgatgaccaaagtytacatattcttgatcttcatggtgctgatcctgccctccctgggtctcaccaggtatatgccaccacyttctgytctaaattcagaataagagtcacatcaggagagcactgtccccagganaatgcaaacgggttggcagca

SEQ ID NO: 38 - DNA, 672 bp, Homo sapiens
  SITE (353): n equals a,t,g, or c
gtagtcgttgcggttgccgggatggcgaagatctcgccgtttgaagtcgtaaaacgcacctcggtaccggtgcttgttggtttggtgattgtwatcgttgctacagagctgatggtgccaggaacggcagcagcggtcacaggcaagtaaatagtaatgccggagcaagtttcctccggctttatcatgtcacccactgtggtatatgcgttgtggtctgccaactttgccgtgaacaatttcagcaataatcagatggcggctggcgcaatattcaagataacgcctggcagtggtgcggctgatggttcagtgcctgcgscaccgtttytgccgtatgttgcacaccaggntctttaaacagttttcgsaccgcgtttagcgtcaagggttcaatgccggtcggtagctcgtccttaggttcaccgcgagcataagcattaaacatctcatcaatttgcttctggctggcgctatcaatactttccagcatatgtttacgctggcggaaacgggttagcgtttgccccarcmgwtcataggcaatgggcttaatgagataatcaaatacaccacaacgtacggcttcagacaccgtttccatatcgctggctgcagtggtaaacaccacgtcgccgggataatgcgcctgcaccagttcatgcagtaaat

SEQ ID NO: 39 - DNA, 1908 bp, Homo sapiens
  SITE (62): n equals a,t,g, or c
  SITE (63): n equals a,t,g, or c
  SITE (1893): n equals a,t,g, or c
  SITE (1908): n equals a,t,g, or c
agagttgatatttttagaaacagtaattttacttttaaggaaattggctagctctttgactnnagagctgtaggaagctcaacatttctttgtagagaacgttgctttttttggattgtacaggtataaaaacattgcttttgttgaattgtataggtgtaaaaagggaataactgtatgcaggtttgaaaaggaaatgtgctttaggcatgagtcataagatgccattgtacttgtaggcattttattttcctttagaaatggacatcagctcttctcttctgactggtaacacatagccccaaagcatgagattatttttcattgggtttttattgttgtttagttttggtttgttacgccagcccagtctgtctgcggaacactgactctgctctctaatgagaacaaagttagaaatctgccgataacctaaaataatttagaaatgaattaaaaatgtgaaatcgggttaaagtgatgatgataaaatagcatgcaagaaacaagctccttccatcagacttggctactgttttcttctggtacgatttggtttggaagagcctcttgtttccttctctttggggtatgtcttcgtttcttaatatgtttgtaacattattgagatataattcacataccttacaattcacttattttaagggtacaatttagtggtttttagtgtattcacaaagttgtgtaaccgtgaccacagtcaattttagaacatttcgttaccccaaaaagaaaccctgtacccttgagcagtcacctctcattttctcccagtgcccaccccatccccgagcccckggaaccactaatctatttctctctctgtagatttgcttattctggtcatttcatataaatggaattctacaatattcggtcttttgggactggcttcccaaatatgattttctatatggagtgagaaaattcttctcatcttgagaactcttattgctgtgaaagggagtggttggtaaaatcaatagatttcaggcaagagggccagatacctaacaggtttttctccgtgaatcttatgctgagtagtttttcctcataaccaagcatttatgatatattactacttataatactgtggctagtctctagaatggatgttgaaatctttgcctcctcagtcgggaagagtcctgctaaaaatcaggctaaaaatcaggccaaaaatcaggccaaatgacttggcaaataattgacaaagtggttttcacgtgtgtctatctttgctagcagcttgtatacctcaggccaggtgagctccccaaatttcttttttcatttactccagtgagtttctgctgtctttttcaagtatgtaccataggacttaaaggtgatttggatgcgttgtaacactgctaaatatgctaagtacagaattttatctacagtactgtgagacagtcaattattgcctagggtagttcaaaaatatgatgtgagctagttaagcctttgcttgactgatttcagtgatattcagaagtgtgtaccaatcaaggctctttaaaatacggaacgactcacttaataaccagggaaccagccaaatactgtgcagccgcagaatatgcatatcaatgagttggaggtgattattctctgtaactccctaatgattgttttctaagcattgtggcttctcagtggcttgacagcatcttcctggttgtatgtggcctgtttacatgatgtattgaataatgttgtttgttgtgagcatcaatgcctgtaacaccaaactaaacacgtgtttttgggatatgtttccaatctttaaatgaccttgccctgtccaataaataaatgattgtctcaccctgttaaaaaaaaaaaaaattaaaaaaactgggnggggggcccggtacn

SEQ ID NO: 40 - DNA, 458 bp, Homo sapiens
  SITE (16): n equals a,t,g, or c
  SITE (443): n equals a,t,g, or c
cctcaaaaaaaaaaangaaaggaaagaggtctctacacaagcccgtgattcttcatggcaagggataacatcagaaatgtttcatttyckgctattagtttccattcctttccccatccaggcataaagagaaacaaaagacaatgatggtattctctgtgtcctcagctttggcacttttgttgatgttgctaaggagcagtgaccttgctaaaaagactgaataatccacccactgaatagctaacctggggaggaaatgaaaatttcctttgtggatctccccaaatccattgttgtcaccaggccctcccagaacctcctcagttccttcacagtgcaaccctgtgtacttggcccgcaacccaatagtattgtgcctcacttcaccttccatgggcaactgccctcccttctggacataaaacctcatattttaaatnaagttgaaatttgaa

SEQ ID NO: 41 - DNA, 1153 bp, Homo sapiens
ggcacagagcctccgacccaggtggtctggagcctgccgggagagtggtggcatctgagaggctggtcgtggactgtggttgggggaggtgggagctgttttaaccgtgtgccccctctcctgtgccggcgtgggcatcccccggggcagtggaacccgggcgctcctccagcttccgagtccagccagcctgggcgcggggcgcgccccgagacacccgaggagtccgttcctccctggttacgtggactgtggagctggtctcttgtggctcagcgccgtgcggaggttgaagcgtacctgcggaggtcgcaccagggcgtgaggaggaggaggaagggcatgagccgagcttgaggaatccgtgctccaaactctacactcaaggatgcactgcgcaactctggtggcgatgggctggggcagatgtccttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgtgtttgacacaggcttgcgggacgtgcagccctacctgtacaagatctccttccagatcactgatgccctgggcacctcagtcaccaccaccatgcgcaggctcatcaaagacaccctgccctctgagcgtcgctggatctctgggagctccttgatggctcccagaccttggcttttgggaattgcacttttgggcctttgggctctggaacctgctctgggtcattggtgagacttggaaggggcagcccccgctggcttcttggttttgtggttgccagcctcaggtcatccttttaatctttgctgacggttcagtcctgcctctactgtctctccatagccctggtggggtcccccttctttctccactgtacagaagagccaccactgggatggggaataaagttgagaacatgagtttgggctgaaaaaaaaaaaaaaaaaaaaaaaaaaaaaaaaaaaaaaaaaaaaaaaaaaaaaaaaaa

SEQ ID NO: 42 - DNA, 1983 bp, Homo sapiens
  SITE (1179): n equals a,t,g, or c
ggcacgagaggggccgagccgacaagatgttcttgctgcctcttccggctgcggggcgagtagtcgtccgacgtctggccgtgagacgtttcgggagccggagtctctccaccgcagacatgacgaagggccttgttttaggaatctattccaaagaaaaagaagatgatgtgccacagttcacaagtgcaggagagaattttgataaattgttagctggaaagctgagagagactttgaacatatctggaccacctctgaaggcagggaagactcgaaccttttatggtctgcatcaggacttccccagcgtggtgctagttggcctcggcaaaaaggcagctggaatcgacgaacaggaaaactggcatgaaggcaaagaaaacatcagagctgctgttgcagcggggtgcaggcagattcaagacctggagctctcgtctgtggargtggatccctgtggagacgctcaggctgctgcggagggagcggtgcttggtctctatgaatacgatgacctaaagcaaaaaaagaagatggctgtgtcggcaaagctctatggaagtggggatcaggaggcctggcagaaaggagtcctgtttgcttctgggcagaacttggcacgccaattgatggagacgccagccaatgagatgacgccaaccagatttgccgaaattattgagaagaatctcaaaagtgctagtagtaaaaccgaggtccatatcagacccaagtcttggattgaggaacaggcaatgggatcattcctcagtgtggccaaaggatctgacgagcccccagtcttcttggaaattcactacaaaggcagccccaatgcaaacgaaccacccctggtgtttgttgggaaaggaattacctttgacagtggtggtatctccatcaaggcttctgcaaatatggacctcatgagggctgacatgggaggagctgcaactatatgctcagccatcgtgtctgctgcaaagcttaatttgcccattaatattataggtctggcccctctttgtgaaaatatgcccagcggcaaggccaacaagccgggggatgttgttagagccaaaaacgggaagaccatccaggttgataacactgatgctgaggggaggctcatactggctgatgcgctctgttacgcacacacgtttaacccgaagntcatcctcaatgccgccaccttaacaggtgccatggatgtagctttgggatcaggtgccactggggtctttaccaattcatcctggctctggaacaaactcttcgaggccagcattgaaacaggggaccgtgtctggaggatgcctctcttcgaacattatacaagacaggttgtagattgccagcttgctgatgttaacaacattggaaaatacagatctgcaggagcatgtacagctgcagcattcctgaaagaattcgtaactcatcctaagtgggcacatttagacatagcaggcgtgatgaccaacaaagatgaagttccctatctacggaaaggcatgactgggaggcccacaaggactctcattgagttcttacttcgtttcagtcaagacaatgcttagttcagatactcaaaaatgtcttcactctgtcttaaattggacagttgaacttaaaaggtttttgaataaatggatgaaaatcttttaacggagacaaaggatggtatttaaaaatgtagaacacaatgaaatttgtatgccttgatttttttttcatttcacacaaagatttataaaggtaaagttaatatcttacttgataaggatttttaagatactctataaatgattaaaatttttagaacttcctaatcacttttcagagtatatgtttttcattgagaagcaaaattgtaactcagatttgtgatgctaggaacatgagcaaactgaaaattactatgcacttgtcagaaacaataaatgcaacttgttgtgcaaaaaaaaaaaaaaaaaa

SEQ ID NO: 43 - DNA, 1406 bp, Homo sapiens
  SITE (141): n equals a,t,g, or c
  SITE (812): n equals a,t,g, or c
  SITE (1340): n equals a,t,g, or c
  SITE (1391): n equals a,t,g, or c
  SITE (1402): n equals a,t,g, or c
atgatgatgactttgaagacgattttattcctcttcctccagctaagcgccttgaggttaatagttggaaaagactctatagatattgacatttcttcaaggagaagagaagatcagtctttaaggcttaatgcctaagcncttggtcttaacttgacctgggataactactttaaagaaataaaaaattccagtcaattattcctcaactgaaagtttagtggcagcacttctattgtcccttcacttatcagcatactattgtagaaagtgtacagcatactgactcaattcttaagtctgatttgtgcaaatttttatcgtactttttaaatagccttcttacgtgcaattctgagttagaggtaaagccctgttgtaaaataaaggctcaagcaaaattgtacagtgatagcaactttccacacaggacgttgaaaacagtaatgtggctacacagtttttttaactgtaagagcatcagctggctctttaatatatgactaaacaataatttaaaacaaatcatagtagcagcatattaagggtttctagtatgctaatatcaccagcaatgatctttggctttttgatttatttgctagatgtttcccccttggagttttgtcagtttcacactgtttgctggcccaggtgtactgtttgtggcctttgttaatatcgcaaaccattggttgggagtcagattggtttcttaaaaaaaaaaaaaaaaacgacatacgtgacagctcacttttcagttcattatatgtaccgagggtagcagtgtgtgggatgaggttcgatacagncgtatttattgcttgtcatgtaaattaaaaaccttgtatttaactcttttcaatccttttagataaaattgttctttgcaagaatgattggtgcttattttttcaaaaatttgctgtgaacaacgtgatgacaacaagcaacatttatctaatgaactacagctatcttaatttggttcttcaagttttctgktgcacttgtaaaatgctacaaggaatattaaaaaaatctattcactttaacttataatagtttatgaaataaaaacatgagtcacagcttttgttctgtggtaacctataaaaaaagtttgtctttgagattcaatgtaaagaactgaaaacaatgtatatgttgtaaatatttgtgtgttgtgagaaatttttgtcataagaaattaaaagaacttaccaggaaggtttttaagttagaaatattccatgccaataaaataggaaattataaatatatagttttaagcctgcatcagtgggagtcttggctatgtagttatgtagttattatgnaaccaccaagatttttttggctatttaccgtaaccaaaggggccgattaantggtttgaagncttg

SEQ ID NO: 44 - DNA, 1391 bp, Homo sapiens
  SITE (1292): n equals a,t,g, or c
  SITE (1294): n equals a,t,g, or c
gggcctgaaggcggcrcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggacccgtcgactcacagatggatgacatggacatggacttagacaggaatttctccaggacttgaaggagctcaaggtgctagtggctgacaaggaccttctggacctgcacaagagcctggtgtgcactgctctccgggaaagctgggcgtcttctctgagatggaagccaacttcaagaacctgtcccgggggctggtgaacgtgccgccaagctgacccacaataaagatgtcagagacctgtttgtggacctcgtggagaagtttgtggaaccctgccgctccgaccactggccactcagcgacgtgcggttcttcctgaatcagtattcagcgtctgtccaatccctcgatggcttccgacaccaggccctctgggaccgctacatgggcaccctccgcggctgcctcctgcgcctgtatcatgactgaggtgcctcccaacgtccgcccacgctgacaataaagttgctctgagtttggagactggtcctcgctccggggagcaagtggggggcgtgcagatgtgcctgtgtctgtctctgagcacctggtgtccgtgtacaaggatggatgtgtncngtggctccttgggaactgagacatatctcagggaatggtgtctgtgctcagcccatccaccagaagagtctgctcacaaaaaaaaaaaaaaaaaaaa

SEQ ID NO: 45 - DNA, 1569 bp, Homo sapiens
ggcacgagtggagatggctgcggccgtggcggggatgctgcgagggggtctcctgccccaggcgggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttattgcgacaccagctgcggaaacacaagatcctgatgaaggtcttccccaaccaggtcctgaaagcccttcctggaggattccaagtaccaaaatctgctgcccctttttgtggggcacaacatgctgctggtcagtgaagagcccaaggtcaaggagatggtacggatcttaagggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagraaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgttacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagcactgctttataataaaatgaaatatattctaaaaaaaaaaaaaaaaaaaaa

SEQ ID NO: 46 - DNA, 1924 bp, Homo sapiens
gggcccccccwcgwkttttttttttttttttttaattaggataatgcctttattaacgagaatgaaacgttcattcctccttccactccttctcgttggttttctggacacagctcacctgatcctgctagaaacgttgtcagtctgcttgtggcttccctccttgattgactcacgctgtgtgatgtcttgagaagtatctatccacttcatgtgaatgagcactccaatatcagccaacatcaatcattcttacctaaagaataataagaaaaagttaatataaaagacaagggtataaaataaaggtttgaaaatgctagtcaacttcaaaatttaaagagtaaaaatccagagataaagattgggggtaagttacagcataaaaaaataggaagaaacttcatggtgggggggaaatctaaaattattcttacataaaataagtagacacctgaattagaatgaaaactgtattttctttaaaatgtaaaagcctgactctcagtttcaccagtctgagcacaagtttgactgcaacccaaaatatactatcccttatgtgaaggtatgtgacaacgttgacctcaccaaatgagttttaacatcagctcttttttcatatgaaagcacataccctgctccccattcaagtatgtcttccattgtcaggcaggctgaccaccttcagcaggagtcctccaagagtgcccaactccccttcccacagtacacaacgctgtagttgttgtcctgcaatcctttgtatttacctcattctttcccatctaagtcctcactgagttttaaagttagggctggaaaagctatgccttactgggacagcaaggaaccaatttttttctgagggagaagacattcaccttcactatatgcctggcagggccacagtgcacaaaacaaagatcagccttcattcaagttccaggtttttcttcctccctgaatgattactgcaaagggtatatgaagtaagagttccctgttgcacatgtaccatccataagggatactatatcgttttgcattcttccccccattctccacattgtcctatcttaagtccaagcccttttcactctcaaaaaaaaaaaaaaaatatttttttcagcactggtgttcaaaagcaacgtttttatggttaatggtttaccagcaactgttgagatttccagttgagtcttaaaaattgccaatcattatctagcagcaatgacagatgattaggagcagtcaaatcctctgaattctttccctaataggcagccatttgagaactgcactagctgacatcactaaaacattatcagctaaagccaaaaccaaataaaggcccagaccaacatcctggctctctaaaacctgtccaaaatcattaagtgaaaggcagtaaatgcaggactgtggatcatgtcactgcagctgacaatgattaacaataggagacatgcaacccccattaaggttaaaagtccaaaactagtcacacgcatctctttattggggaaaagtgagactattatgcattcttggtaggtttgcaaccttgcatgaagagcacccattgcatttctttcatctttcagaaagcaccggtatctgttccaagggcctaacagtacgaaaatacattctggcatcacacctctgaacccaagactgttctcattaaaaataattttggtttgtaacaaaattatgaaatacaatgcaagcacctcggtatagcattattactgaaaccacttaattcccagctttttgagttttttaaaaaaacccactgcactaagattcacaattcattgctacatacaaattaaagctagtaagaacacactaacgtcacaagtttctcattctaaagtgcaaaagcctaatcatctgaaagtgaacagggtaa

SEQ ID NO: 47 - DNA, 475 bp, Homo sapiens
tggtgtggggcccagaaamcaagggaccagtgaaaacamccccagagacttgtatccgccaggaaagccattgccamtyctgagcccttgaagggcaaggagggaaacagtgttaccagagcccagtaagaactgctgtcatgaaggaggggccaccttgtaagagacatcattactaccagaactgtggtgccaaattgctggtgtctctctttggagaaaccaaccagatacatctgctggagacccaggtgggcacagagaagggtggagagagaatctgggaagagaaatggagaataagcagcacagtgttattcatttctgtaaattcctatgtagaaggctcagtgttagaaataaagttattctactagttgcaagttaagtgtttctgtttgttctgctttcctgttagcataagtaaactccctttggaactacacaggtatgtctctccttcaacatgtgtgaa

SEQ ID NO: 48 - DNA, 346 bp, Homo sapiens
aagggacagagacctggattcagatctcattttacaatgaagaccccaatgcagaaagtcatgtctgaaattctgagcttactcttctgcctgctgggacctgctctggatgagagaagggaggaaaaggactaatcagaggagccaatgaagtcactccatgagtttcctgaaccctgcccagctagagattaacgtytgaccwtcaacgtaggacactgtgcagatggctacttgctggcgcacatgaagaccaaagccaggaccaagccccmascctgctwaacacggcagartcttgcccagccmacytctgtgaraatctgcttccctccacagctgaccc

SEQ ID NO: 49 - DNA, 1366 bp, Homo sapiens
  SITE (499): n equals a,t,g, or c
taggtgtcagccgccaccccccccccatatgcagatttactsggcatggtagtggccagcttctaacacagctggtatttcaagtctcctgggacctcactcaggaatgataccccctcagtagaagcagcaggtgatcttaactcctttcaaagagcaggcctgtctgggaagccatgtcctcagcaggcacagcaacccctctggaaatggatcacaaactcacttctcagccaggcaggccaagcttctattgtaacagtaggcacagtatagtcggatcatcacatcagctgggtttttggtttagtcatctagagtcgtctggactaaaggtctttcaggtctccttgccctgtgagtgcgtgaacctccccacccgaattgcctcagttgtcctgagcctcatgtctctcctggtggtgggccaggcccctgcatgggaagggagcctgctgcggggcaggccagctgggggtgctcacctatgcgcaatganagttattgaaggactggttgttgatgttggtgagcgtatccttcatggccagcgcgaagtcggccaggtcagccaggtgctgccagcgctctctctcggacttgtcttcctgtgccaggggaccgtggagaaagtgtcaggggccgctcactgcagcagcctgctctgctgccttccctggcagtgttctgggggtggattccctacamctagatgttcaaggccttacttttcctcccacaaaggagtcgcagccacgctagctctgacttgccactgtgacaaagttcacgtagcaggtctaggcaaagactgggcaattgagcagaggagacggacctgtgagtctgaccrygagscggrccccttcaccttggctgggctggtcctggtccttaggttttgtcaggttgtccttgtttggatccctcaactaggtgataagcactggagggggatgacccgccttggacgtgtttctttaacctcatccatataatagggccgtgggatggttgtagaggtaaagcaggatgatggtgttttaagaccagagcttgggaccagggctcctacacctaattttctctcctggtagctgaacaaaggtctaaattagcttaacaaaagaacaggctgccgtcagccagagttctgaaggccatgctttcagtttcccttgttgacaattgctctccagttcctatgaaagcacagagccttagggggcctggccacagaacacaaccatcttaggcctgagctgtgaacagcagggggttgtgtgtctgttctgtttctctgcttgccgaactttctcaataaaccctatttcttatttataaaaaaaaaaaaaaaaaaaaaaaa

SEQ ID NO: 50 - DNA, 1405 bp, Homo sapiens
gcagtaattcctgttagccactgcatccaccaaaactagtttatttttcccctcaaattcatgatttttacgtctgttacaaagggaattttgctgatagctctttgggtcccactgttccattttatgctaatagattccattctagggcccagccgtctcttgactgatggtgttccctttaacccttggcatgtataatagaattttggtgaatgaaagaacccaaataggccagatagtccccccaggccctgatatccataaaaggcttgggaatgcattatgtaattgtccttagtctttttgttgttttagaaaaaaaaaacaagatgggctcagatggatgcctacgtaaaaatggttcctagctgtgtactcataacttttctttgaattgagtagtgaaaggaaggaggaggaaaggaaattaaatgtccttctagtattctctggactcaagtctgacatatgagataataacctatattgaaatgccaagaattgtatctgaaacaagagaacagtttgacacatttatcatgccttcatattacatattaactgaaaccaattaataaacatatgaaatatccattgcacaaggcaaaggcacctaaaccttttgtttctttttctacatagcagaaattgattttttttttatttttttaggggaacctatataattatgacccagtgatgtcttttggtgacttaagcttatgaattcaggttacaattgagttgattctagatggttactaccttgaaaaggatgttggtgccttatgtgacacgagccagagcctgctggggaataaacaaagcaggtttcatgccaacaccaactcgtagctttagtgggcagatggggagtggttcacagacttcccaaaatgtgggggctttgggattttccacaccatcccacgtgtgttgttcattcttcctcttttcacactcttggatggatwatttgraaatggtgraawymmcyyykraatttgcccaatagccwtgrgccaccattcttwatgacaccataaccaaatagttccwtaatgttgaaatattagaaacctgttaccagccyksmaktwacccwwawttttcccatgtttgtggaattgatattgaaatagcagggctaaggaattactggcaagttttagcctgtgggtaataccttagggttatttaaatatttgtaattttatttaaatgttcatgaatgtttgaaaggaacaaaattatcagggatggctctttgccatgggtcttattttcaccctcttttctgtaagaaaaaagaacaatgtcttaatgtatttttaaagtttttggtatagtttctaattccaattttaataaaagttttwtrtaaaaaaaaaaaaaaaaaaaa

SEQ ID NO: 51 - DNA, 2633 bp, Homo sapiens
  SITE (16): n equals a,t,g, or c
ttcggggccccccccnagtttttttttttttttttttccttcttaaaaatattacatgttttattatcctgtccccagagggtggtttatccagaaaccaagaaaaaaaatcaatcagaataaactcaaaaaaaaaaggtagggggagcaaaaccatcaaccaccaggcagccaggccatcagcccacctccacctctggagggtccccagagacccacgcccgacgcagacccggaggagcatcagcaaggggcccgggcagagaatcggctatgtcttcattatgagagcaggagagacggcagagatatgttgctaggtgaatatatatttatataataaatccgtaagttaataaagtaaatagtaattctctgaaagtttttaattctttcttttttatagtttttttgtttttgtgattttttttttttttggtttttgttgttttgtgttttttttccttttttttttttggttcttagaaaatctgagacacgtgaggccagacaaagcaaggccggggctggtgggatggggtgcggttcaggggggcccggtctgccaactcagctcctctgctgcaaaagcggggtgcttgttggggccatctcctggcaatggcaagtgagtctggagcagagaggggagaggggctgggtgggtccccagccgtcaggtggtggtggcgccctctgctggcccctcgcatggcccaggcagttcctggacaaggcacatggggctttggcctggattggggaggccttgaagggacctcagagcaaaggaagagacctgggtgtggtgaggcatcccagggcatggaagggaccggttgtgctgtgggaatccactggcccctccttggttaaaaaagcacaacacatcatacatatttaccagaccagaagcgctggccccaagtctccccaacctggtcgggggaacctcctggccaacccacaaagagagagaggagagagcctgccccagcccctccctgcccacccacccaccccggaggactgcagagagtgctttgcatagatacagagtggaggaatgggactgtggggctgcccaggcccctcctggaggccgtcgggggtgttgggtcaggtctctggggcctcacaggtygctctcgccatacaaggccgtggagaaggacttgtagtcgagggcaccgggcacggcgtcagggccctggtatggcsccatgcgggcgatgcagtactcggcctggtcggggggcagctctctccgcagctcctcagctgtgatgaagttcttgtcccctgctargaccttgaaggaagcgatgacctggtcagccgtgtccgtgtcggtggtctcccgcgacatgaagtcgatgaaggcttggaaggtcacaaggccgctatggttggggtcgaccaggctcatgatgcggttgaactcggcctcaccctgccggtcgttctccacgtcgtagcccaggctgatgaggcaggccttgaactcctcgggccccagcgccccgccatgatccttgtcgaagtggttgaaggacgcccggaactcctgcatctgctcctggctgatgcccttggcgtcgcgggtgaggatctggttctccacctcgttgatggtgcgggcaatggtggtgagcagctgctcccagcccacgcggatgtgctccatggtatagttggtgtgcttgttgtcgaagatgagggcctcctggatgagctggtgctgctgctccagcaggtccaggttgggcttgtagtccacgatgctgcgttcatactgcttcaggtggctcagctggtcctccagggtcccgttcatctcaatggagatgcgcccgatctcctccatcttggtctggatccagggccccacaacattggcctggctggcgaactggcggcgcaggtgctcgttggactgctgcttgctctgctcctccaggagggcatggtcccgttttggcaccagctgctgcaccttctcccacttggagttgatgatttgcggggtgacggtggtgtaggggttgctgcccgacagcttgatgtggttgctctcagcgatcctctgggcctccttgtggatggccaggatggcctcgcgctccctatcggcgtccggcagggtggacttgaactggtcatgggctgagatcaggccctcaatctcctcgatggtatggacgatgaacatgtcctggaggtcctccatggcgctctccatccagttgttgaagggggccgcgcgcttggcgtattccaggtgcagctggtcgatggcctccagctgcttctctgttttctccagggcttccctgcgactatgtgtcagagagccgagggcgtcccactggtcacagatcttctggcaccgggtgttgacattgtgggagtcgtagtaatccagctcgttgagctcctgggcaatggcggcgatctgctccacgcggtcctggtgcgcagccaggtcgctctcgaaggcctcgtgcttgcgaatgagggctttgatgtccgatagtgtggccgtctcgtagtcccggtgcttcagcatggcttccttcccgtcagtccaggcctcgtggatggaggccttctgccggaacttctctcgtgcc

SEQ ID NO: 52 - DNA, 777 bp, Homo sapiens
  SITE (1): n equals a,t,g, or c
  SITE (168): n equals a,t,g, or c
  SITE (755): n equals a,t,g, or c
  SITE (771): n equals a,t,g, or c
naagtatcttggccagtttattacagaggacgataaatgattccatgtggatagggcataacatacagagaatgagactatgccagaaatgggaggaggcatttgaaacaacatgagtatctcagggacagatggattgattctgctattggtaggcctggaagcaanggtcagaagtagcaaaaaatggataccaaaagcactattwgtcacccaagctaagtggaatagctggcccagtaggagaaatgcaggttttgctctacactaagttctccaactcttgataagcctccaaaaacaaatgttaggggaaaaaaacgcagctggttatgaaaagatatatctcatttcattaaaaaatcaatgtcaatgctgttaatagaatccttttatcttcaggacagaggcaatgccctaaacaaacaccagctcaagagcctctgatgccaacctagagggtacccaaacacaaacttagcatagaggtaagaatctctatgtcttttggtggaggcaaagccatttggttggtacttcacaggaacatctttctaccaagtcttcatcatatggtatgtgccacgagtctccagttgtttgcaccactgtgtcatagctgagaatacgctgaaaggttagttttgatcctggaaacctatttacaattgccagctgatgtccctgctgccacttaaaaaaggcttgggtctggcataggcagamaggcctgtggtcccctcgtgccgattctnggctcgaggccaattnccttat

SEQ ID NO: 53 - DNA, 602 bp, Homo sapiens
atgactacagtgttataccctccaatctttgcaggtgggcatggaacactgcttgtatcactctgtgcacggtataaatccatatatccacaaaaacacacatccatccatcaacatatacatggtttgggatgagcaggtcaatagttttgagagggagtttgttccttttttttttctcattatactcttaaattgttgtcagttatcaaacaaacaaacagaaaaattgtttggaaaaaccttgcatacgccttttctatcaagtgctttaaaatatagactaaatacacacatcctgccagttttttcttacagtgacagtatccttacctgccatttaatattagcctcgtatttttctcacgtatatttacctgtgacttgtatttgttatttaaacaggaaaaaaaacattcaaaaaaagaaaaattaactgtagcgcttcattatactattatattattattattattgtgacattttggaatactgtggaagttttatctcttgcatatactttatacggaagtattacgccttaaaaatacgaaaataaattttacaaggttccggttttggtggtggaaagagtaaattga

SEQ ID NO: 54 - DNA, 1749 bp, Homo sapiens
  SITE (1747): n equals a,t,g, or c
agtcactgacttggagccgctcgggggaagtcccgcccagacaggcggtgggtgggaatgcctcacttcagtttgaagagggtccggatccaaaggggttaaaacgagcgaaccccgatccccgaccacacttcccgcctccctaaaacgcacaccccgctagccatgggcagccgcgaccacctgttcaaagtgctggtggtgggggacgccgcagtgggcaagacgtcgctggtgcaggattattcccaggacagcttcagcaaacactacaagtccacggtgggagtggattttgctctgaaggttctccagtggtctgactacgagatagtgcggcttcagctgtgggatattgcagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgaccattttattaagtacatttgaattgtctcctgactactgtccagtaaggagggcccattgtcacttagaaaagacacctggaacccatgtgcatttctgcatctcctggattagcctttcacatgttgctgrctcacattagtgccagttagtgccttcggtgtaagatcttctcatcagccctcaatttgtgatccggaattttgtgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggaggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcckgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaaaaaaaaaaaaaactcgagggggggcccggtacccaaatcgccstgatagtgatcgtawacaatcnaa

SEQ ID NO: 55 - DNA, 1896 bp, Homo sapiens
  SITE (1825): n equals a,t,g, or c
  SITE (1862): n equals a,t,g, or c
  SITE (1871): n equals a,t,g, or c
  SITE (1879): n equals a,t,g, or c
aaagagatgggctctttattttctcgaaaaaccaatttggagttactcatttttccataacattaaatttcttacagtgaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcattgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcayatatcactgtaaggtacagttaggggtaacactttagaggtttattatttttaaaaaacttttcttgaactcctgggccaacatgggtgaaaccccgtcttcttacttaaaaatacccaaaattaggccaggggcgtggatgggtggggtgcctgttaatcttcagctacttnggggagggcttgaagccagggaggaactgccctgganccccggggngggccagnaggtttgccagttgagt

SEQ ID NO: 56 - DNA, 1753 bp, Homo sapiens
tctttttaaaatagacatttgtggggctcacacaatatatgaaatagtaccctctaaaaaagagaaaaaaaaaatcaggcggtcaaacttagagcaacattgtcttattaaagcatagtttatttcactagaaaaaatttaatatcaaggactattacatacttcattactaggaagttctttttaaaatgacacttaaaacaatcactgaaaacttgatccacatcacaccctgtttattttccttaaacatcttggaagcctaagcttctgagaatcatgtggcaagtgtgatgggcagtaaaataccagagaagatgtttagtagcaattaaaggctgtttgcacctttaaggaccagctgggctgtagtgattcctggggccagagtggcattatgtttttacaaaataatgacatatgtcacatgtttgcatgtttgtttgcttgttgaatttttgaacagccagttgaccaatcatagaaagtattactttctttcatatggtttttggttcactggcttaagaggtttctcagaatatctatggccacagcagcataccagtttccatcctaataggaatgaaattaattttgtatctactgataacagaatctgggtcacatgaaaaaaaatcattttatccgtcttttaagtatatgtttaaaataataatttatgtgtctgcatattgcagaacagctctgagagcaacagtttcccattaactctttctgaccaatagtgctggcaccgttgcttcctctttgggaagaggaaagggtgtgtgaacatggctaacaatcttcaaatacccaaattgtgatagcataaataaagtatttattttatgcctcagtatattattatttaattttttaggtaatgcctatctcttggtctattaaggaaagaagcaatcagtagagaattcaggatagttttgtttaaattcttgcagattacatgtttttacagtggcctgctattgaggaaaggtattcttcyatacaacttgttttaacctttgagaacattgacagaaattatgcaatggtttgttgagatacggacttgatggtgctgtttaatcagtttgcttccaaagtggcctactcaagaggccctaagactggtagaaattaaaaggatttcaaaaactttctattcctttcttaaacctaccagcaaactaggattgtgatagcaatgaatggtatgatgaagaaagtttgaccaaatttgtttttttgttgttgttgttgttttgaatttgaaatcattcttattccctttaagaatgtttatgtatgagtgtgaagatgctagcgaacctatgctcagatattcatcgtaagtctcccttcacctgttacagagtttcagatcggtcactgatagtatgtatttctttagtaagaatgtgttaaaattacaatgatcttttaaaaagatgatgcagttctgtatttattgtgctgtgtctggtcctaagtggagccaattaaacaagtttcatatgtatttttccagtgttgaatctcacacactgtactttgaaaatttccttccatcctgaataacgaatagaagaggccatatatattgcctccttatccttgagatttcactacctttatgttaaaagttgtgtataattgttaaaatctgtgaaagaataaaaagtggatttaaattaaaaaaaaaaaaaaaaaaaaaaaaaaaaaaaaaaaaaaaaaaaaaaggggg

SEQ ID NO: 57 - DNA, 1220 bp, Homo sapiens
gcggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatcawaaaaaaaaaaaaaaaa

SEQ ID NO: 58 - DNA, 1049 bp, Homo sapiens
tcgcgcctgcagacacagcatctactcagcgtgggtcacctctgtgaacatcactgactgcaagcctccctcaatttctggtgcagcccatcagggacccacagcgcctgggaggatggtgcggatcttggccaatggggaaatcgtgcaggacgacgacccccgagtgaggaccactacccagccaccaagaggtagcattcctcgacagagcttcttcaataggggccatggtgctcccccagggggtcctggcccccgccagcagcaggcaggtgccaggctgggtgctgctcagtcccccttcaatgacctcaaccggcagctggtgaacatgggctttccgcagtggcatctcggcaaccatgctgtggagccggtgacctccatcctgctcctcttcctgctcatgatgcttggtgttcgtggcctcctcctggttggccttgtctacctggtgtcccacctgagtcagcggtgacctctgagggctgataggggtgggtttgttgagagggacttgctgggccttggtgtgagagcaggcatatttggaggggatctggtggtgccttgaaggtatgatcagagaggggaccacaggtgtgtgtttcccctttgtgttaagcgtgaggcagagggagacgttagtcccagcatttcccaaagtgtgggtgggtccgttggttcccgagatacttttaggtggtatggggcctgcattaagtggcacaaaatcagagcaagaaagcgatgcccttcccaattctctcaatccttttatgccgagaagatctcagctggatgccaacatgttccgatgcctgtggaagacatgccgacgtctcctctgcctagggagcaggacttgggcttagggcaggtggaaaaaattccagacttttttagcactgtttttgttttaatggtatatttttattggctactttattgtttaggacaagtggtagtggcattctatttattgtgaccttttcaataaatagatttaagtaaaaaaaaaaaaaaaaaaactcgagggggggccc

SEQ ID NO: 59 - DNA, 1776 bp, Homo sapiens
  SITE (713): n equals a,t,g, or c
  SITE (862): n equals a,t,g, or c
  SITE (1752): n equals a,t,g, or c
  SITE (1773): n equals a,t,g, or c
aaagaggatgtgmagctagaggtccccgatggctggtcggatgggaagcacaaggctgagggactggattgtaaaggcactaagtcgttctgcggtgagaatcagacatgggggacctctagcttcacatcctctttccttgcagstctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctkaanaaaaaccattaaagttacgacggcagcagcagccgcagccacatctcaggaccctgagcaacacctgactgagctgagggaaccagctcctggcaccaaccagcgccasccagcaagaaagcctcaaagggcaaggggctccgagggancgccaagatttggtccaagtcgaattgaaagractgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagkcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatctatgagaaatctatctacaaamwaaaaaaaaaaaaaaaaaaaaaaaggaattcgatntcaagcttatcgataccgtcnacc

SEQ ID NO: 60 - DNA, 443 bp, Homo sapiens
  SITE (341): n equals a,t,g, or c
  SITE (436): n equals a,t,g, or c
acagataaataaataaataataaattaaattaaataaaaaatctgagctaatctgaataaattgagagatttcacatgaaagccaggatttctggcttcccaggaacagtcagaagagctagctagcaacactggtctgcttggctaccttctttggaacaacatgaaatctagctcccttttttttttttttttggcccacttcatccattcacatgacctgcctggcctctgcaggtaagtgagtatgcaacaaaaatgtagcacaggttttgtcgctgaactacgtggtttcaggtccagctctgccacttgctagcatgacctcgtgccgaattccngcacgaagttttttttttttttttcagtgctccagtccccctattggagaatcctgcccccccctgggacagaatgttcaccctggccccgcgantccctga

SEQ ID NO: 61 - DNA, 2888 bp, Homo sapiens
  SITE (112): n equals a,t,g, or c
ttaatgttgtcaataaccaccaggccaaacagaatttatatgacctggatgaagatgatgatggtatagcttccgttcctactaaacagatgaagtttgcagcctcaggcgnctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtgaactctgcctcctcctccaacccccctgcygaagtggaccctgacaccatcctgaaggcactcttcaagtcctcaggggcctctktgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagytcttggcttggagtcccgtgtcgtctccrcccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaraaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattcctaaaaaaaaaaaaaaaaaactcgagggggggcccggwacccawatcgccskaaagtgag

SEQ ID NO: 62 - DNA, 1851 bp, Homo sapiens
cactagtataatttataattataacctattctgatttcttttcaaatattaggtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagccgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgctattctgtgcacttaattaaactgattgtgatgacttwwaaaaaaaaaaaaaaaaaaaaaaaaaaaaaaaaa

SEQ ID NO: 63 - DNA, 3542 bp, Homo sapiens
  SITE (1984): n equals a,t,g, or c
  SITE (3534): n equals a,t,g, or c
  SITE (3537): n equals a,t,g, or c
tccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggwtcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtggscacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccagggktgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcanyttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatgcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatgaaaaaaaaaaaaaaacttacaanccncaagg

SEQ ID NO: 64 - DNA, 883 bp, Homo sapiens
  SITE (832): n equals a,t,g, or c
  SITE (858): n equals a,t,g, or c
  SITE (871): n equals a,t,g, or c
aggtgattttaatgataggtgtcatatataggacggataatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacaggggtggcaaaatatgcctgacggatcatttcaaacctttgtggggccaggaatgtgcccaaatttggactagctcatctcatggctctggggctgggtccatggstggcagtggaaatccctgatctgattcagaagggcgtcatccaacacaaagagaaatgcaaccaatgaagaatcaagccactgaggcagggcagagggacctttgataggctacgatactawtttcctgtgcatcacacttaactcatctaactgttccccggacancctccactctagttgttactaagtantgcagtagcattntggggaagaaca

SEQ ID NO: 65 - DNA, 1541 bp, Homo sapiens
  SITE (760): n equals a,t,g, or c
ggcacgaggtggcctctaccctgggctcatctggctacacagggactctaaacgcttccagattccctggaaacatgccacccggcatagccctcaacaagaagaggaaaataccatttttaaggcctgggctgtagagacagggaagtaccaggaaggggtggatgaccctgacccagctaaatggaaggcccagctgcgctgtgctctcaataagagcagagaattcaacctgatgtatgatggcaccaaggaggtgcccatgaacccagtgaagatatatcaagtgtgtgacatccctcagccccagggctcgatcattaacccaggatccacagggtctgctccctgggatgagaaggataatgatgtggatgaagaagatgaggaagatgagctggatcagtcgcagcaccatgttcccatccaggacaccttccccttcctgaacatcaatggttctcccatggcgccagccagtgtgggcaattgcagtgtgggcaactgcagcccggaggcagtgtggcccaaaactgaacccctggagatggaagtaccccaggcacctatacagcccttctatagctctccagaactgtggatcagctctctcccaatgactgacctggacatcaagtttcagtaccgtgggaaggagtacgggcagaccatgaccgtgagcaaccctcagggctgccgactcttctatggggacctgggtcccatgcctgaccaggaggagctctttggtcccgtcagnctggagcaggtcaaattcccaggtcctgagcatattaccaatgagaagcagaagctgttcactagcaagctgctggacgtcatggacagaggactgatcctggaggtcagcggtcatgccatttatgccatcaggctgtgccagtgcaaggtgtactggtctgggccatgtgccccatcacttgttgctcccaacctgattgagagacaaaagaaggtcaagctattttgtctggaaacattccttagcgatctcattgcccaccagaaaggacagatagagaagcagccaccgtttgagatctacttatgctttggggaagaatggccagatgggaaaccattggaaaggaaactcatcttggttcaggtcattccagtagtggctcggatgatctacgagatgttttctggtgatttcacacgatcctttgatagtggcagtgtccgcctgcagatctcaaccccagacatcaaggataacatcgttgctcagctgaagcagctgtaccgcatccttcaaacccaggagagctggcagcccatgcagcccacccccagcatgcaactgccccctgccctgcctccccagtaattgtgaatgccatcttcttccttctcttttttataatattgtacatatggatttttttattgtttagatttaaccagcttttaaatctctgttttctgtgacagtgttagaagtttgtgattctccaaatatgcctagatttaaagctgatttaatttatggaaaaaaaaaaaaaaaaaaaaaaaaa

SEQ ID NO: 66 - DNA, 732 bp, Homo sapiens
agaaaatgaatgttagaaggtgcctgccgaggcgggacagagtgtttgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggcggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatcaaaaaaaaaaaaaaaaaaaaaaaaaaaaaaaaaaaaaaaaaaaaaaaaaaaaaaaa

SEQ ID NO: 67 - DNA, 631 bp, Homo sapiens
  SITE (575): n equals a,t,g, or c
  SITE (626): n equals a,t,g, or c
ttaaggaattcggcmcgaatcccggcaagtaacatgactaaaaagaagcgggagaatctgggcgtcgctctagagatcgatgggctagaggagaagctgtcccagtgtcggagagacctggaggccgtgaactccagactccacagccgggagctgagcccagaggccaggaggtccctggagaaggagaaaaacagcctaatgaacaaagcctccaactacgagaaggaactgaagtttcttcggcaagagaaccggaagaacatgctgctctctgtggccatctttatcctcctgacgctcgtctatgcctactggaccatgtgagcctggcacttccccacaaccagcacaggcttccacttggccccttggtcaggatcaagcaggcacttcaagcctcaataggaccaaggtgctggggtgttcccctcccaacctagtgttcaagcatggcttcctggcggcccaggccttgcctccctggcctgctggggggttccgggtctccagaaggacatggtgctggtccctcccttagcccaagggagaggcaataaagaacacaaagctgnaaaaaaaaaaaaaaaaaaactcgtagggggggcccgtacccaatcgccctntcgtg

SEQ ID NO: 68 - DNA, 1751 bp, Homo sapiens
  SITE (1665): n equals a,t,g, or c
  SITE (1741): n equals a,t,g, or c
  SITE (1748): n equals a,t,g, or c
ctgctagccggccggcgcaggctgccgagcgggtgagcgcgcaggccaggccaaagccctggtacccgcgcggtgcgggcctcagtctgcggccatgggggcgtccgcgcggctgctgcgagcggtgatcatgggggccccgggctcgggcaagggcaccgtgtcgtcgcgcatcactacacacttcgagctgaagcacctctccagcggggacctgctccgggacaacatgctgcggggcacagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatngtaccatctcccccgccaataaaaaaaaaaaaaaaaaaaaaaaactcgagggggggcccggtacccaattctccgnaataggnagt

SEQ ID NO: 69 - DNA, 508 bp, Homo sapiens
ggcacgagattatgtattaaaatgtttttgaattgtgaaatattagaatattgttactatttgacccaactcaaaatctccatgggaaaatacctgtcgatacccacagtattgttgaaaataatcagatgcagtatcacagctgtgtcagactctagtaccagttgggcaatcaaggcacagctaaaaattgaaaacaaagatctggacaacaaaacagccaaaggtgggggtcaagaagctctgacgtgtacctagctgtagaatgctatgcacacgtgccaggtgtagtgtgcatatccaggaaaaactgcagagagccccagtcttcacctctggttgaccatgagctctgtgtaagcaggaagtgaaggctaaggcagatttaagctctgaaagcattccacaacatacacacaaatcgtgcaaagcattaaggaaatcttgttactgctaagtgttgctgacccaggaacaactcctactcagctggacttaaaaataaaaa

SEQ ID NO: 70 - DNA, 245 bp, Homo sapiens
  SITE (241): n equals a,t,g, or c
  SITE (243): n equals a,t,g, or c
tacatagagcaaagagaaatttccagaatttctaraattctggaaagagaattttcctgagattgcagatttgcttgtgtcctcaggtgatgatgagggctgttttcccctgttgtcctttcctcacactcatgcttcctctcctagagtgtctggttggcatgatcatgtgctacctaggcatttctttcactgatacaaggaaaactgcagggttaaaaaaaaaaaaaaaaaaaaaaancncg

SEQ ID NO: 71 - DNA, 361 bp, Homo sapiens
atgttcctcatgaggatgcacttgtgcttctgcaagtattgctgcagcttcatagtgactcccaccagcaccagcaatacagctagctacctgtggccttggatctcagccagcatggctgggagagggagcagctgggcatgtaccctaaatgctgttaccagggaaggactcccagagtgaagacaagtagggacttcctgcagaggtggtacatgtgctctctgtatccatacttttttttttttttttttgagatagagtttcacccttgttgccctggctggagtgcaatggtgcgatctcagctcactgcaacctctctgcctcccgggttcaagtgattctcctgcctcagcct

SEQ ID NO: 72 - DNA, 713 bp, Homo sapiens
aggatcacacaatagagaacactgtagtaacatttcggtctgctcacaagacccagaacattgatcagtttttgttgttggtttattatttttctgttaaaaaattgtgaaaagtttgttttagctagatgatattttaatagctgcgagtgctttggaactataaagatgtcactacttaacacacataccttatgttttgttttgttttgttttacactcagtataaatcaggagaagttagccaaccatctagcatttagaatcctcttttttattgtcttctaaggatatggatgttcccataacagcaacaaaacagcaacaaaaacatttcataaatatcacttgatagactgtaagcacctgcttaactttgtgtcccaaatatttagtgtgtatatatatatatatatatacacacacacacacatatatattcaacaaataaagcaaaatataacatgcatttcacattttgtctttccctgttacgattttaatagcagaactgtatgacaagtttaggtgatcctagcatatgttaaattcaaattaatgtaaaacagattaacaacaacaaagaaactgtctatttgagtgaagtcatgctttctattataataacttggcttcggttatccatcaaatgcacacttatactgttatctgattgtttataataaagaatactgtacttataaaaaaaaaaa

SEQ ID NO: 73 - DNA, 862 bp, Homo sapiens
gaaagtcagagctgtccaatccctcagcaccttttagatttgctccaaattagaaacgtggggactatgtgttctgggcaatcacaggtctggaaaatggctctgcaggctcttgatagtgagacagtggtcatcttaccagacatgcatctgattttaagcctcaggctaatccacaatgctcggccatgcctatgattaacaaacaaaagcaaaatctgcttttatagtttaggaaacctggatagaacagtatttttcagcattcttggataaagcagttctgcatttttaaattgggactgcagaagtgactgtctatagttgtgaaatacaaaaaatggtatgtttgatcagaaaaggaagcccgtgcctggcacttggaaagatactgagcatcataaccctaatgagaaaatgtaggctctgtgaatgttaactacaaatcaggttaggaaagcatatgacaccctttgtcaaactaagcttcactaggaggacctgtgctcatagaagaatatgctttaaaagtatcaattttccacagtcgatgatggagaaaagttcatttgcaccagaatgctgatagtcacaatacacagcctgacatatataacaatacagttttctgtaaacagaagttcttcctcttccaattcaggagtcagtcagagcataaatattgcatgtttcactttagaaactgattcattttagaaagcagatctggattattttgcagggtagaaatgaaggctatttctggcattcttgctcaaaaagtcaatatatgtacattaagtataaaaaagggtctctttcacctcttttgtttcgtagcattggctacataactcgtgcc

SEQ ID NO: 74 - DNA, 4602 bp, Homo sapiens
gcgagggggcgkggggagcagcgccgargccgccgcctccgcctccgccgcctaggactagggggtgggggacggacaagccccgatgccgggggakacggaagagccgagacccccggagcagcaggaccaggaagggggagaggcggccaaggcggctccggaggacccgcaacaacggccccctgaggcggtcgcggcggcgcctgcagggaccactagcagccgcgtgctgaggggaggtcgggaccgaggccgggccgctgcgrccgccgcgcmgcagctgtgtcccgccggagaaggccgagtatccccgccggcgaggagcagccccagcgccaggcctcccgacgtccccgggcagcagcccaggccgcgaagtccccgtctccagttcagggcaagaagagtccgcgactcctatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctacaaaccccacttagaaagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagagaggaagaagacgaaaagatgacaaaagtccacgtttacccaaaaggagaaaaaagcctccaatccagtatgtccgttgtgagatggaaggatgtggaactgtccttgcccatcctcgctatttgcagcaccacattaaataccagcatttgctgaagaagaaatatgtatgtccccatccctcctgtggacgactcttcaggcttcagaagcaacttctgcgacatgccaaacatcatacagatcaaagggattatatctgtgaatattgtgctcgggccttcaagagttcccacaatctggcagtgcaccggatgattcacactggcgagaagcattacaatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacgggtgagcctgatggctgatgggaagatctttgtgggaagcggcagcagtggaggcactgaagggctggttatgaactcagatatactcggtgctaccacagaggttctgattgaagattcagactctgccggaccttagtggacaggaagacttggggcatgggacagctcagactttgtatttaaaagttaaaaaggacaaaaaaaaaatctaaagcatttaaaatctagtgaaataactgaagggcctgctctttccattgtggatcacagcacacacatacatacaccctccacctccccatcccctgttctccctctgttgctccccttataaaattgatgttgtctttaccagaaaggtagacaaaaaagaagcagcagcagctcttaaagtgagggttattctcatactcggttccagccatcagcagacttcctgctcatcggcagatccccctttccaacctgtaactctgatgtgctctggatcagcttttaacttttaatcatatattactgtcttctaaatcccttctcctcctctactgctgccctatggttctggctcctaccccctgcggcacacttatcttcaaataccatagaattctaatctctgaaatcatagctctccagtggcttttaaagaaagctggtcctcagcactaacaaaatcactacaatagcctagtgcttttttggaagcctttttagggaagaatgttaggttcatggtaactagtatgctctttgagatttttacagtgttgaaacttaagaattttgagagggtgaggagggttgttcagaatctaaattacagatagatgattgtttcttgtgaatttgtttcttttcctttttttttgtccctaccatttccttacatttcccttggggcccatctctggctccttgctttttgtttcttgctttgctttatcagttcattccagctccctgttagtgaaggacactgctgttagtgaaggaacaaagtctatgagtcctaaaattttaagtcaaagaaaactgctctgtttcccctttagtaacacttctgaagaggaaaaacttcaatagccaaagttaataatcctatataataattgctttggctttcacctaaaattctgggcatcacaatttccttgggatagaggttgtgttggggaatagattgcttattgctgttcactggagagaaaaggtagtgtttttgtacaaggtcataccgccagaagccccaaatcctattttggctcatcttcaggtaaagagtaattcctatcctgtgtgcctcagaagctagaatcgaaggcttaccctattcattgtttattgtcagaaatgcatgatggctcttggaaagaatgacgttttgctggaaaaaaaaaaaaraacmgtttgtgtttcacaaacatggcttatcaattttttcaaagaattcttttttcccaaaaagaggagtaacaaaatgtcatttctgaaagaggcttactttataccaactagtgtcagcatttgggatgccagggaacagagagtgagacacctacaatcaccagtctcaaatgcgctattgtttcttttcagagtgttgcagatttgccatttctccataatatggggatagaaaatggaataaagatagaagggatgtagaatatgctttcctgccaacatggtttggagtcgactttggtatattgactagatttgaaaatacaagattgattagatgaatctacaaaaaagttgtcctcctctcaggtcccttttacactttttgactaactagcatctatattccacacttagcttttttgtcacacttatcctttgtctccgtaaatttcatttgcagtggttagtcatcagatattttagccacctacacaaaagcaaactgcatttttaaaaatctttctgagatgggagaaaatgtattctcctttcctataccgctctcccaacaaaaaaacaactagttagttctactaattagaaacttgctgtactttttcttttcttttaggggtcaaggaccctctttatagctaccatttgcctacaataaattattgcagcagtttgcaatactaaaatattttttatagactttatatttttccttttgataaagggatgctgcatagtagagttggtgtaattaaactatctcagccgtttccctgctttcccttctgctccatatgcctcattgtccttccagggagctcttttaatcttaaagttctacatttcatgctcttagtcaaattctgttacctttttaataactcttcccactgcatatttccatcttgaattggtggttctaaattctgaaactgtagttgagatacagctatttaatatttctgggagatgtgcatccctcttctttgtggttgcccaaggttgttttgcgtaactgagactccttgatatgcttcagagaatttaggcaaacactggccatggccgtgggagtactgggagtaaaataaaaatatcgaggtatagactagcatccacatagagcacttgaacctcctttgtacctgtttggggaaaaagtataatgagtgtactaccaatctaactaagattattatagtctggttgtttgaaataccatttttttctccttttgtgtttttcccactttccaatgtactcaagaaaattgaacaaatgtaatggatcaatttaaaatattttatttcttaaaagccttttttgcctgttgtaatgtgcaggacccttctcctttcatgggagagacaggtagttacctgaatataggttgaaaaggttatgtaaaaagaaattataataaaagggatactttgcttttcaaatctttgttttctcttattctaggtaaggcatattaaaaataaatatgtaaagaagaaaaataaaagttgtcttcatgg

SEQ ID NO: 75 - DNA, 1255 bp, Homo sapiens
  SITE (1227): n equals a,t,g, or c
  SITE (1231): n equals a,t,g, or c
  SITE (1251): n equals a,t,g, or c
cgcgccccgggccggcgggtttctctaacaaataaacagaacccgcactgcccaggcgagcgttgccactttcaaagtggtcccctgggggagctcagcctcatcctgatgatgctgccaaggcgcactttttatttttattttatttttattttttttttagcatccttttggggcttcactctcagagccagtttttaagggacaccagagccgcagcctgctctgattctatggcttggttgttactataagagtaattgcctaacttgatttttcatctctttaaccaaacttgtggccaaaagatatttgaccgtttccaaaattcagattctgcctctgcggataaatatttgccacgaatgagtaactcctgtcaccactctgaaggtccagacagaaggttttgacacattcttagcactgaactcctctgtgatctaggatgatctgttccccctctggatgaacatcctctgatgatcaaggctcccagcaggctactttgaagggaacaatcagatgcaaaagctcttgggtgtttatttaaaatactagtgtcactttctgagtacccgccgcttcacaggctgagtccaggcctgtgtgctttgtagagccagctgcttgctcacagccacatttccatttgcatcattactgccttcacctgcatagtcactcttttgatgctggggaaccaaaatggtgatgatatatagactttatgtatagccacagttcatccccaaccctagtcttcgaaatgttaatatttgataaatctagaaaatgcattcatacaattacagaattcaaatattgcaaaaggatgtgtgtctttctccccgagctcccctgttccccttcattgaaaaccaccacggtgccatctcttgtgtatgcagggctatgcacctgcaggcacgtgtgtatgcactccccgcttgtgtttacacaagctgtggggtgttacgcatgcctgcttttttcacttaataatacagcttggagagatttttgtatcacattataaatcccactcgctctttttgatggccacataataactactgcataatatggatacgccttatttgatttaactagttccctaatgatggacttttaagttgtttcctttttttttcttttttgctactgcaaacgatgctataataaatgtccttatcaaaaaaaaaaaaaaaaaaaaaaaaaaaaaancccngggggggggccccgggaacncaat

SEQ ID NO: 76 - DNA, 475 bp, Homo sapiens
ggcacgagagaaatgtttgattctctttcctattttaagggatcttctctcttgttgatgttgaaaacttaccttagtgaagatgtgtttcaacatgctgttgtcctttacctgcataatcacagctatgcatctattcaaagtgatgatctgtgggatagttttaatgaggtcacaaaccaaacactagatgtaaagagaatgatgaaaacctggaccctgcagaaaggatttcctttagtgactgttcaaaagaaaggaaaggaactttttatacaacaagagagattctttttaaatatgaagcctgaaattcagccttcagatacaaggtacatgccctctttcttttcatgccatctcttttgcactctcaggtggaaatattttgaagtgttttataatcataagttcttgtgaaacctaacaagattatcccttcctaagaatacttaaccttcctaccaaattaaaa

SEQ ID NO: 77 - DNA, 465 bp, Homo sapiens
  SITE (458): n equals a,t,g, or c
  SITE (462): n equals a,t,g, or c
ttctctctgctcttcgactgcaccgcactcgcgcgtgaccctgactccccctagtcagctcagcggtgctgccatggcgtggcggcggcgcgaaccrgcgtcggggctcgcggcgtgttggctctggcgttgctcgccctggccctgtgcgtgcccggggcccggggccgggctctcgagtggttctcggccgtggtaaacatcgagtacgtggacccgcagaccaacctgacggtgtggagcgtctcggagagtggccgcttcggcgacagctcgcccaaggagggcgcgcatggcctggtgggcgtcccgtgggcgcccggcggagamctcgarggctkcgcgcccgacacgcgcttcttcgtgcccgagcccggcggccgaggggccgcgccctgggtcgccctggtggtcgtgggggctgcacctttcaaggacaaagtgctggtggcggcgcngaangaa

SEQ ID NO: 78 - DNA, 1907 bp, Homo sapiens
  SITE (1781): n equals a,t,g, or c
  SITE (1802): n equals a,t,g, or c
acatgcagcccaactacagattcttatggaattcctcaaggttgcaagaagaaataagagagagcaactggaacagatccagaaggagctaagtgttttggaagaggatattaagagagtggaagaaatgagtggcttatactctcctgtcagtgaggatagcacagtgcctcaatttgaagctccttctccatcacacagtagtattattgattccacagaatacagccaacctccaggtttcagtggcagttctcagacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccacagttgagcttggaaagtttttgtcaaatgcngcaagagataactctttttangaagtagcatatgtgaactataatgtaacagtgaataatttgtaaagttcgtatttcccaacctctttgggaattacacatatcaatataaacaaaatataaagt

SEQ ID NO: 79 - DNA, 1168 bp, Homo sapiens
  SITE (1148): n equals a,t,g, or c
  SITE (1149): n equals a,t,g, or c
gctggggtgtcccckcsgccaccatcgtcatcgcttacttgatgaagcacactcggatgacccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtgacaatggtctggatggaaaggattgctgctctccattaggagacaatgaggaaggaggatggattctggttttttttctttctttttttttttgtagttgggagtaagtttgtgaatggaaacaaacttgtttaaacactttatttttaacaagtgtaagaagactataacttttgatgccattgagattcacctcccacaaactgacaaattaaggaggttaaagaagtaatttttttaagccaacaataaaaatataatacaacttgtttctcccccttttccttttaagctatttgtagagtttatgactaaatagtctgtgcaggttcatagaccgaagatactacacactttaaaccaattaaaaagaaccaaaagtaaatagaaaagacattgaatcaccaaggcctgggatcaacctgggctgtccacacagaaaacaaaaacccaaccaaaccaagccctgttgtgctcactggtgcaaagagaagatcagggcagcttaagtggtctaagratccttcaggcattctttaaggagaaaaaggatacctttgattttgtgtgtttcatgctctggattttttttttttttccttctctgggtttaagagattttttttgaaatagtgaggaactgaccattatatgccttcactggcttcttgtgcaataatatgatgttttaagtgtgcaaacaagttagagctggcagctgaatgatagacaaatagtgcaaatttgccagcttggagatagaaaggaattcaacaatatatcaaatactttccttcccacctttttccttttttttttttttttctgatttgattctggttacagtgccataaaccttgttacatatgtatatcagaatgtaagaaaaaaaaatttatttaaaaatatttttcgcaaaaaaaaaannaaaaaactcgaggggggcc

SEQ ID NO: 80 - DNA, 1285 bp, Homo sapiens
  SITE (561): n equals a,t,g, or c
agaaaatcacatcctaacaaagaagtctgtctaagacagtacatctcctgttgaacttgcatctttccacaggactttctgtttttagggatgagactattctctgcttcatcaaggaaagagaaatgttcagggttgtagggatggcacacttattagttctgcctgtctgaaaggttcctgcaggacagtttggtcagagctgcaattcttagtccatggtctaatgcttgagtatctcttctttccctttcctgtctcaggaatcagctgagaattcattcgattgtcatgcctctagccccttactgtgatttgttggttgcactttcatttgctttagttctagaatcacctgttgactcctcagacttcacctaactttggaaactctcttttggaggcttctcatttccccctaattctgtgctgcctgagccctagaattttcccaccaacgaattattccaggtagatcctaagttgctggatctagttgatatttaaacaatatctagttgatatttctcattcagttggatccagaaaccagtatctctnaaaaacaacctctcataccttgtggacctaattttgtgtgcgtgtgtgtgtgcgcgcatatgtatatagacaggcacatcttttttacttttgtaaaagcttatgcctctttggtatctatatctgtgaaagttttaatgatctgccataatgtcttggggacctttgtcttctgtgtaaatggtactagagaaaacacctatattatgagtcaatctagttggttttattcgacatgaaggaaatttccagataacaacactaacaaactctcccttgactagggggacaaagaaaagcaaaactgaccataaaaaacaattacctggtgagaagttgcataaacagaattaggtagtatattgaagacagcatcattaaacagttatgttgttctccttgcaaaaaacatgtactgacttcccgttgagtaatgccaagttgttttttttattataaaacttgcccttcattacatgtttcaaagtggtgtggtgggccaaaatattgaaatgatggaactgactgataaagctgtacaaataagcagtgtgcctaacaagcaacacagtaatgttgacatgcttaattcacaaatgctaatttcattataaattgttttgctaaaatacactttgaaactatttttctgtattccaagagctgagatcttagattttatgtagtattaagtgaaaaaatacgaaaataataaacattgaag

SEQ ID NO: 81 - DNA, 1290 bp, Homo sapiens
  SITE (1279): n equals a,t,g, or c
tctccagccccaatttctacgcgcaccggaagacggaggtcctctttccttgcctaacgcagccatggctcgtggtcccaagaagcatctgaagcgggtggcagctccaaagcattggatgctggataaattgaccggtgtgtttgctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatggatgtcatcagcattgacaagacgggagagaatttccgtctgatctatgacaccaagggtcgctttgctgtacatcgtattacacctgaggaggccaagtacaagttgtgcaaagtgagaaagatctttgtgggcacaaaaggaatccctcatctggtgactcatgatgcccgcaccatccgctaccccgatcccctcatcaaggtgaatgataccattcagattgatttagagactggcaagattactgatttcatcaagttccattcacccagccaggtggtctcgtcacctcagaggctccgcagactcctgcccaggccaggactgaggcaagcctcaaggcacttctaggacctgcctcttctcaccaagatgaactcactggtttcttggcagctactgcttttcctctgtgccacccactttggggagccattagaaaaggtggcctctgtggggaattctagacccacaggccagcagctagaatccctgggcctcctggccccsggggagcagagcctgccgtgcaccgagaggaagccagctgctactgccaggctgagccgtcgggggacctcgctgtccccgccccccgagagctccgggagcccccagcagccgggcctgtccgccccccacagccgccagatccccgcaccccagggcgcggtgctggtgcagcgggagaaggacctgccgaactacaactggaactccttcggcctgcgcttcggcaagcgggaggcggcaccagggaaccacggcagaagcgctgggcggggctgagggcgcaggtgcggggcagtgaacttcagaccccaaaggagtcagagcatgcggggcgggggcggggggcggggacgtagggctaagggagggggcgctggagcttccaacccgaggcaataaaagaaatgttgcgtaactcaaaaaaaaaaaaaaaaaaanctcgggggggg

SEQ ID NO: 82 - DNA, 684 bp, Homo sapiens
tttattgtattctgtaactatagaacttctatttwattcttttttggacttgctaagttgtctttwatggttttwagttccatgctgaagttttcagtattgacttatccccttgaacatgagttgttttatagactctratgattcaaaaatcttacatcttttggtagtctctttcatttgtycactgtttctgttgattctwactcatggtattttaattcttcgttwttttttttctgttwagawacattctttgaaaaataatttggaggaatatttgattcttatgaacaaggcattactcaccagagaagatttttttgttytaccargtgcctargaatgctaacagtctgggamcacatagamcaccaggtgatgagacaatcctgggartcctgttttactttggsccatcttttctcccaaccctgtgggaatartcatycatatcctarctgcaggctaraaggtggtttatcagagcccaacttcgagggctctgggctttagctactgtcaccccatcataactgagcttcatggattgattctctttttatctttcagattttcttttaaaaatctttgtttttttttttcttccgaaagattcccccaacattaccattccccaccttccgttgaatttttttggctctcattttgaatttttcaaga

SEQ ID NO: 83 - DNA, 2024 bp, Homo sapiens
ctgcaggaattcggcacagctgcgctggaggcttcatctttgccgccgctgccgtcgccttcctgggattggagtctcgagctttcttcgttcgttcgycggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcgatgaaaatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggtacagcagggaagaactggaaactcagagaaagaaactgcccttccatctacaaaagctgagtttacttctcctccttctttgttcaagactgggcttccaccgagcaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtactatttcaaaaataaaaagacagcaatgactttatatccaaaaaaaaaaaaaaaaaaaaaaaaaaaaaagggcggcc

SEQ ID NO: 84 - DNA, 931 bp, Homo sapiens
cgcgccmatagccggacggggatctgagctggcaggatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctcttattctccatactgtcttctacacctttaaagcctgagaactatacaacctttcccagactcccaagaagagaagagattggcaaatggggctcctgggcccagtcctgctagtggcaagtttctttgaatcaggaaggcaggtgaggtaagggccaaatcactctcctccatagcaggaagccatttgggcagctcctttggtgattacatctttccatatcttttacacttaccaccttccagctctgttttgctgtgtatttttcttacaataatttttttcagctatagctgcagtttaatcaggatgggtagagagctgtcctcataaggctgggggtgggaagatggaatactg

SEQ ID NO: 85 - DNA, 825 bp, Homo sapiens
cggggccggcggggtcttcagggtaccgggctggttacagcagctctacccctcacgacgcaaacatggcagcgcagaaggaccagcagaaagatgccgaggcggaagggctgagcggcacgaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtggtgacgtcccctatgttgctggtggctctggctgtctttttcggcgcctgttacattctctatctgcgcaccttggagtccaagcttgtgctctttggccgagaggtgagcccagcgcatcagtatgctctggctggaggcatctccttccccttcttctggctggctggtgcgggctcggccgtcttctgggtgctgggagccaccctggtggtcatcggctcccacgctgccttccaccagattgaggctgtggacggggaggagctgcagatggaacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcaggaaaaaaaaaaaaaaaggggggcccctctaggggtcaaagtta

SEQ ID NO: 86 - DNA, 1238 bp, Homo sapiens
  SITE (567): n equals a,t,g, or c
  SITE (651): n equals a,t,g, or c
  SITE (1014): n equals a,t,g, or c
catgtaaaaggatgaaatgtgacttctggtgtttttttatttctatggagggactttctggggacggtttctggctctcaggctctgagaagctgcagtttatgagtggctctgtgtgtgctgccacctactggagaagccataagctgcagctttaggaaaagggaacccggggcagagtgtggggaagtgggatggcagcatggcagggctttggaaaatgagaggtgagagtktktccaggaagggtgtaaggagaggatggatcctgatacatggattcaggatcattagggtcctgtctgggacactggccttcctgcttacctgctctttccttcctccttggtcggaggaggggctggctcactgctctggcttcattttccagagctgcctgctgcagtcacacttaggtcatcttctctcacttttctccttttgccgattagtggacgtgacagagatgtgaatggggcagggatgtcctttgatggcatcaagactttagcttctggtgcgctgtgtcccagctctgatttcagttgcagccgtgatggamagttngcatggaagctgagactctcactgacagtgaaaccctcaaatgaacacaatccctgctttcctgccaaggatccttgtagggtncccccagcttccccactttttttctgtgtcctgacaaagaaacacagagtaacttgattgccctgtgacctggccagttgcatttcccctgcaggcttgagcccaagccagagccttgaaaaggtattcaggttgttgcccaaaacactgaaaaaaactgccctggccctgaaccaaataccttgaaccctcgtaaactccataccctgacccccttgttttggatatacccaggtagaacaactctctctcactgtctgttgtgaggatacgctgtagcccactcattaagtacattctcctaataaatgctttggactgatcaccctgccagtcttttgtcttgggcaatctatacttttnctcagaggttcccaaggcctactgaagggacttaacatactcttaatggctttcctctctcttgttttaccttatgccctcacttcctgagttaacctcccaaatacaggattcacctgtacccaagcccttagcttcaagaatacaggatcacctgtacccaagcccttagctcaagctctgctttggaagaacccaaactaagacagtgctcctggtgccct

SEQ ID NO: 87 - DNA, 1460 bp, Homo sapiens
attgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcgcgaccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcacttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctggagaggctgccgctcacctacctgcacatctgccacagctggccctgggcccaccccacgaagggcctgggcctaaaccccttggcctggcccagcttccagagggaccctgggccgtgtgccagctcccagacactacatgggtagctcaggggaggaggtgggggtccaggagggggatccctctccaacaggggcagccccaagggctcggtgctatttgtaacgggattaaaatttgtagccagaaaaaaaaaaaaaaaaaaaaa

SEQ ID NO: 88 - DNA, 1395 bp, Homo sapiens
  SITE (967): n equals a,t,g, or c
caggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggaytcgtgggcgctcgcactggcgctgatgtagtttcctgacctctgacccgtattgtctccagattaaaggtacgacatttggaggccccagcgagaaacgtcaccgggagaaacgtcaccgggcgagagcggkcccgctgtgtgctcccccggaaggacagccagcttgtaggggggagtgccacctgaaaaaaaaatttccaggtccccaaagggtgaccgtcttccggagacagcggatcgactaccatgtgggtgcccacaaaaattycacctytgagtcctcaactgctgaccccggggtcagttccagagagaaggactccctcctgcttggaagagacctcacaccgtcatcacgatgccaacggctctgaaggtggatggcattcctgcgtggattcatcactcccgcatcaaaaaggccaacrgagcccaactagaaacatgggtccccagggctgggtcaggccccttaaaactgcacctaagttgggtgaagccattagattaattctttttcttaattttgtaaaacaatgcatagcttctgtcaacttatgtatcttaagactcaatataacccccttgttataactgagggaatcaatgatttgattccccaaaaacacaagtggggaatgtagtgtccaacctggtttttactaaccctgtttttagactytccctttcctttaatcactcagccttgtttccacctgaattgactctcccttagctaagagcgccagatggactccatcttggctctttcnactggcagccgcttcctycaaggacttaacttgtgcaagctgactcccagcacatccaagaatgcaattaactgataagatactgtggcaagctatatccgcagttcccaggaattcgtccaattgattacacccmaaagccccgcgtctatcaccttgtaataatcttaaagcccctgcacctggaactattaacgttcctgtaaccatttatccttttaacttttttgcctactttatttctgtaaaattgttttaactagaccccccctctcctttctaaaccaaagtataaaagcaaatctagccccttcttcaggccgagagaatttcgagcgttagccgtctcttggccaccagctaaataaacggattcttcatgtgtaaaaaaaaaaaaaaaaaactcggagggggggcccggtacccaa

SEQ ID NO: 89 - DNA, 1186 bp, Homo sapiens
  SITE (54): n equals a,t,g, or c
  SITE (55): n equals a,t,g, or c
ggcacgagccggcaagccgagctagggtgaaaactgggggcgcaccaggatgtnngacagaaaagcagaagatgagactctgttcattcacttttcctaggcccatcctgtggtcatctttccccctcccatcatacctcctccttcctggagcctctgccggcttggctgtaatggtggcacttacctggatatttcagtgggaggatgaaaggcgagactcaccctacgcggtgggacagatggggagaggaaaaaggcagagatggccaggagaggggtgcaggacaaaccagagaggttgggtcaggggaaaagggtggggagaaagaggggtgcaggccctgcaggccggttagccagcagctgcggcctccccgggcccttggcatccaacttcgcagacagggtaccagcctcctggtgtgtatcataggatttgttcacatagtgttatgcatgatcttcgtaaggttaagaagccgtggtggtgcaccatgacatccaacccgtatatataaagataaatatatatatatatgtatgtaaattatggcacgagaaattatagcactgagggccctgctgccctgctggaccaagcaaaactaagccttttggtttgggtattatgtttcgttttgttatttgtttgtttttgtggcttgtcttatgtcgtgatagcacaagtgccagtcggattgctctgtattacagaatagtgtttttaattcatcaatgttctagttaatgtctacctcagcacctcctcttagcctaattttaggaggttgcccaattttgtttcttcaattttactggttacttttttgtacaaatcaatctctttctctctttctctcctccccacctctcacccttgccctctccatctccctctcccgccctcccctcctccctctggctccccgtctcatttctgtccactccattctctctccctctctcctgcctcctgctgccccctccccagcccacttccccgagttgtgcttgccgctccttatctgttctagttccgaagcagtttcactcgaagttgtgcagtcctggttgcagctttccgcatctgccttcgtttcgtgtagattgacgcgtttctttgtaatttcagtgtttctgacaagatttaaaaaaaaaaaaaggaaaaaaaaaaaaaaaaaaa

SEQ ID NO: 90 - DNA, 1821 bp, Homo sapiens
  SITE (547): n equals a,t,g, or c
  SITE (1723): n equals a,t,g, or c
  SITE (1754): n equals a,t,g, or c
  SITE (1794): n equals a,t,g, or c
aaaacatgctttcagggcgtcccctatgtattcggggggcccacggacactcaggctggakatccgtcctcactgcgctcaagatggcctcagcagacaccagttacccagctgaaagtcacaatccctcccagaagtctcccaacactagtgctgaccagaggtggggctctcaggctaggagtttcacacacaatgacaggctgctgggggacattgcaggaccccttttcctytcctctccatgctagaagccagccctaggmagctgcagttactccctgtgactcagcagcaggctgattcaacacagctgcccacacaaagccagtggtaatacatctgtttacctttccctatcacccagacacaagcccctttcccaggtcaaaccacaggccgatgcatctccagtttgacagtcaaatcactacttccattgctactttagatcagccaaagtggtgactgctgcagtgtgtggctatccctacaaggcccacccaagggatgcccaaagcccaaccttctccagggctgcagcagnagcaaccccaccagcctaagtccagcagaggacctcccacccaatgtcttgttctaattagaaggggaagttagccacagaaaatcaacttatctataattacaaaattctcttgactcaccttaaagttcctattgacatctactgcttttaaacctatttgaaaactctgatactaaaacaaatgacactctaagaaagtttgggagccccatgctgagaaccatttctgtgcagtgaggatgtttccagaagctacttacctacatgtgaatgtgccattttctttccttttgtagagaaaatcccctttactttttggaacagtaatggcagcttctagtacagccattacagtttcatatgagaaaaattaagaataactataaaattgttaaaatatccaataatggataatgatggccagaagatttaacatacaaagtaattctcaatgtaaagctattcagctcttccaggttgaatgccctgtaacccaccctgaccttccacatcatcttcaaaaagcagtttctctgttccccatgattctcctataaggtaactctttagtcctccatttagcacattttaaatcctccaaagaataagtatcatgtgattattttagctttacaaaaaaaaagttgaatggcgttttattttcatggcctataagcaggtaccttagtagggcagatataggaaaaacaaattagagcaaaacaaatcctctacaaatccaaggcaggaaaagtggtggcagagtgactcattctcctgtccctcccatcaggtcaaatcaggaggctgcagtgaatgcctgttctttgaatgtgtagcagttgttcctgtaactctttaaaacttggctataggctgtttagcacagtacagattaaagatacagttacgtaaacagcaaagtaattttatagtgcttcatccatttatcatgctttggtttgctaattttttcacatacctttttctatcacagtctgttgcttttgtacacatttctcatattggggttcgacaggtaaacacaaactgctatttcagtagaaaaagttattgttatggaatattaaacccaataaattgtataaagggtaaaaaaaaaaaaaaaaaaaaaaaaaaaaaaaaaaaaaaaaaaattcctgcgggccgcangctttttccctttgggtgaggggttattttnggcttgggcactgggcccttcgtttttacaacgtcgtganggggggaacccggggggggtttccccc

SEQ ID NO: 91 - DNA, 862 bp, Homo sapiens
  SITE (27): n equals a,t,g, or c
tgccctttttcccaccgattcggggcntggtgaaggtgggagatgtgaactccaattaagggactggagagaggtgaagaattttgcaggtgggagatttggatttgaatgtggacttgtaaatgacttgaccttgccatctgtgttcaaggtcacggtttgctgtggggttcctgggagagcttactcaccccggagtcttttctttctcttgctccaagaagagccctgttggtgctttaccaccgcttggagtctcccgaggacacaaacaggcagagagggacgtgtagggagagttctttcctgttttctgtgctttcctttttacaggactcccggaaggccactcatggccatgccaggagctttctcagaaacagtcataaacgatctcttgagtctctttcttgtcctcccagctgagctttcttattccaccctttctggtgtctataggaatgcatgagaagaccctgggacgtttttctgctctcttctggccctccatggagccatgggcctcggcctcggcggctcctcaccctcacaatttatttcctcctcccgtgccagcccttcttttgtgtctgaaaccggttttaaaatgtgactctcccagagaagaagccgctggctgtatgaaacttgacggcgcttttgtaaggtgccacccccaaactttaaggtagctaaaccaatttttaaaagattcaatggcttgttcatcctccagatgtagctattgatgtacacttcgcaacggagtgtctgaaattgtggtggtcctgatttataggatttcataattaaaatgtctgctgaataaaaaaaaaaaaaaaaaactcgaggggggcccggt

SEQ ID NO: 92 - DNA, 696 bp, Homo sapiens
  SITE (626): n equals a,t,g, or c
ctgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcaggacccagctgtgatccagcaccgacccagccggcagtatgccacgcttgacgtctacaacccttttgagacccgggagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaaggagcgagagctgcagcatgctgccctgggrggcacagctactcgacagaacaattggccccctctaccttctttttgtccagttcagccctgctttttccaggacatctccatggagatcccccaagaatttcagaagactgtatccaccatgtactacctctggatgtgcagcacgstggntcttctcctgaayttcmtcgsctgcctggccagttctgtgtggaaaccaacaatggcgaggctttgggtt

SEQ ID NO: 93 - DNA, 1886 bp, Homo sapiens
  SITE (829): n equals a,t,g, or c
  SITE (1123): n equals a,t,g, or c
  SITE (1886): n equals a,t,g, or c
caggccactgacgcttctttgcgagggatgcaggaggtcctacagagaaaggcgcttcttgcatktcagagggcccacagcctgtcacccacagatcaccaagcagctttctacctggctctgcagcttgccatctccagacagatcccagaggctctggggtatgtccgccaagctcttcagcttcaaggtgacgatgccaactccctgcacctccttgccctcctgctgtcagcacagaagcattaccatgacgctctgaacatcatcgacatggccctgagtgaatacccagaaaatttcatactactgttttccaaagtgaagttgcagtcactctgccgaggcccggacgargcactgctgacttgtaagcacatgctgcagatatggaaatcctgctacaacctcaccaaccccagtgattctggacgtgggagcagcctcttagatagaaccattgctgacagacgacagcttaatacaattactttgccagacttcagcgatcccgagacaggctccgtccatgccacatcggtagcagcctcaagagtggagcaggcactgtcggaagtggcttcgtctctgcagagcatgcccctaagcagggcccgctgcacccctggatgacgctggcacagatctggctccatgcagctgaagtctatatcggcatcgggaagcctgcagaagccacagcctgtacccaagaagctgccaacctcttcccaatgtcccacaatgtcctctacatgcgcggccagattgctgagctccggggaagcatggacgaggcgcggcggtggtatgaagaggccttagccantcagccccacccacgtgaagagcatgcagcgacttggccctgatccttcaccagytaggccgytacagtytggcggagaagatcctccgggacgcggtgcaggtgaactcgacagcccacgaggtctggaacgggctgggcgaggtcctccaagctcagggcaacgatgcggcggctacggagtgcttcctgacagccttggagctggaggccagcagccccgccgtgcccttcaccatcatcccccgcgtgctctgagcaggcgcctgccagcctcacctgccgctcagcctncagaggccctgccgggcaccagggcttgtgccatcgccccaaggggatgaatctgccgcactgaggccagggacgagtgttcagtgggccacagtgaaccaaccaaaccaaccccgaatcatcgctctcgccatgtgcgtttctcttgttttttttgccagcccaatggtagtttctgaacctattgacattgttcaaaatggatcatgtgccatattttgttagttgacatctgagttttcagtaaaatgattatggaattaatcagcaaatgtagaagaatatattcaaagttaaaattcagtggcagcacagattatttttatcagagctgtaaagaaaacaactgtccttttctccccaccacccctcctgccccactttggcccagaaaccaaatgtgaacttcctgtctcccacctcagcactagtccatgccaggacaccagctgacaatttcttggttttactgtcaataattgtaccatgtgatcaattactgtcctcacttagaacaaagcctgagtccgagaatatttatattttaccaatatatgcctgttacaagagaaggaaatatgagttatttaagtttaacttttttatgtgaattcagagtttatttatcgagggaaatatgtacaaagaagcttcaaatggaatatttaccgacattccttatacatgacagacacttggctacatgggaagatgatgttaataataaaatgatttttaaatggaaaaaaaaaaaaaaaaaaan

SEQ ID NO: 94 - DNA, 1774 bp, Homo sapiens
ctcagctaccgtatacagtaggacataaccccatttcacatgcactacactgagacttgcctcctctccccccacattgaagatgttcttttttcataactatatactattccattgcatgaatattctgtaatttatttaatcccctatggattgataattaggttcattatagatagaagtgtaattaacattcctgtacatgtattttgctacttgtgtgggtatttctgtaggatgaataactagaaatttattggatcaggtttcacatttgcagttttgaaaactactaccaaaaagatttcaccaatttacaactccatcattagtaagaatgcctgtttgcctatagtctgccaaccctgaatccttaaaaatttttgccaatctggtaggcaaaatttctttcttttctttgaatattaatgaggaggaacatcttttcatgtttcttggccatttgcatttcctattatgaattgcttttgcccattttcctttttttaattatgaaagtctaatgactaccttctcattgtataaaaaacacagttctttgaatagagagacccttttctccaatgctaccaatcacattccacttaccacagtttaacatacatcctctagtcacctttccgtacgaatatacatacacataaaaacactttttacataaataggatctcatattctgtagctttttaaaattttggtctcaaaaaaagataacaggtctttaaatttctttaatggttgaatatgattaaatactatgaaaatgccattatttattcccttaatttttttcctctcgctattacattgccaaagtaaacatcctattcagatgtctttgtgcatgtgtgtgaatatttctttagtctggagtccagtaaggtggatttttggatcaaagggtttgttctctgtccaccttcagtcttcccaaaggccttcataactgtattttcaccaagtgtatggagaatgttcatttccccatataaccatacctacacttgatagtttttatctgttgggcgaaaaagaaccttttcttattttgcatttccctgattataaaaaaaaatggtgagattggggttattttcatgtttattggccatttatagtttactgtggattgtttgtatcccttacctgctttctattgggttatgtgtggatatattgtttttatttgttcagcatctccttccccatcttctggtaacacaacctttatttatttgtggggaacctattccctgtggcttaggtgagcatgtgaccaggcctggcctcctgagtcccacagcttcctagccacagtgataaaagaatgggtatataacttaagccaggctaaggaaagcccttaacagaacttctgctggaactactggaaagaaggctttatggagatcccaggaaccaaggaccatgtaagcctgaatttgtgccatgtggagagagtctgtctgaggagaaactcggatgctagcagaaatggaaagagaactaagttctgatgtcatttttctggaggccctagatccagctgtgcctaaagcctgccctactccggactttaaagttttgtgagccaataaagtccctttcttgtttaagataattgaattgagtttctgttctgattaatataggttatttgtattttcttattgatttgtagaaaacctttgtaattttaaattctagactttatgcactatataagttaataaaattagcatggccttccatg

SEQ ID NO: 95 - DNA, 1779 bp, Homo sapiens
  SITE (1731): n equals a,t,g, or c
  SITE (1748): n equals a,t,g, or c
  SITE (1754): n equals a,t,g, or c
gctgtttactaggcacgactgcgaaggcaagggggcaccagctcaggactgcatctgcctgccatttcccttccactcctcctttctggagtctgacattagaaagccagcgagaaggaagattcaaacaaccaaccctgatttcctgcttctccttttcatgagtgttcctgtggtctctgcacctcctttctgtcccccggcagagggcagtagagatggccggcccaaggcctcrgtggcgcgaccagctgctgttcatgagcatcatagtcctcgtgattgtggtcatctgcctgatgttatacgctcttctctgggaggctggcaacctcactgacctgcccaacctgagaatcggcttctataacttctgcctgtggaatgaggacaccagcaccctacagtgtcaccagttccctgagctggaagccctgggggtgcctcgggttggcctgggcctggccaggcttggcgtgtacgggtccctggtcctcaccctctttgccccccagcctctcctcctagcccagtgcaacagtgatgagagagcgtggcggctggcagtgggcttcctggctgtgtcctctgtgctgctggcaggcggcctgggcctcttcctctcctatgtgtggaagtgggtcaggctctccctcccggggcctgggtttctagctctgggcagcgcccaggccttactcatcctcttgcttatagccatggctgtgttccctctgagggctgagagggctgagagcaagcttgagagctgctaaaggcttacgtgattgcaagggttcagttccaaccatggtcagaggtggcacatctgctcagccatctcattttacagctaacgctgatctccagctccagcgatggaacccactacagaggaggtggggcccctgtgtcaaagaggccgaggggcagcaagggcagccagggcacctgtgacttcttagtacaagattgtctgtccttcaggacttccaaggctcccaaagactccctaaaccatgcagctcattgtcacaccaattcctgctttaattaatggatctgagcaaatcttcctctagcttcaggagggtggggagggagtgattgctgtcatggggccagacttccaggctgatttgccaaatgccaaaatgaaacctagcaaagaacttacggcaacaaacgaggacattaaaagagcgagcacctcagtgtctctggggacatggttaaggagcttccactcagcccaccatagtgagtgggccgccataagccatcactggaactccaaccccagaggtccaggagtgatctctgagtgactcaacaaagacaggacacatggggtacaaagacaaggcttgactgcttcaaagcttccctggacctgaagccagacagggcagaggcgtccgctgacaaatcactcccatgatgagaccctggaggactccaaatcctcgctgtgaacaggactggacggttgcgcacaaacaaacgctgccaccctccacttcccaacccagaacttggaaagacattagcacaacttacgcattggggaattgtgtgtattttctagcacttgtgtattggaaaacctgtatggcagtgatttattcatatattcctgtccaaagccacactgaaaacagaggcagagacatgtaaaaaaaaaaaaaaaaaactcgagggggggcccggtacccaaktcgcccttatagngagtcggaattaacaanttcaantgggccgtcgtttttacaacggtcg

SEQ ID NO: 96 - DNA, 2801 bp, Homo sapiens
  SITE (2209): n equals a,t,g, or c
ctggaaagccgagggtagccgagcggggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcacgacmagcggcccctggaggaggaggcggaggaggaggagcatgtcggacggtttcgatcgggccccaggtgctggtcggggccggarccggggcctgggccgcggagggggcgggcctragggcggcggtttyccgaamggarcggrgcctgctgagcggrcgcggcaccagccgccgcaacccaaagccccgggcttyctgcarccamcgccgctgcgccarcccaggacgaccccgccgccaggggcccagtgcgaggtccccgccagcccccagcggccttcccggcccggggcgctcccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattraggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcgtctggaaatacatattactgcaaaaatgtagcatccttttttaggtaggagtattatagcttycattttagttkgacatttagtgtcccaatgaattgaatttcaaatatgaatcataatcttgaaaatctttagcactaaagtcttgggaatatatcaacaactgatttacatatgcagatgctatttgnataccaagggctttttaaatgtcatgggggggaaaaacccaacttggtggaactcccagctaaacaaccaagacttcactggaagatttattccaattctaggaattgttcttttttatttttattttttcaactgrctaacttcattaccttaaagcctagaacattattctgctttatttatatggctttctcacttttattttgtagcakgggttgcatcgacttttttactagagaattttactagatatttgtcattcaagttttcatctgctttataattgatacaccttgagggtcacttttctaatacttttactataatgtggtaccacctcagccctaataaataatatttttacctaatgtcaaatctttttccagctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaaaaaaaaaaaaaaaaaaaaaaaaactcgag

SEQ ID NO: 97 - DNA, 1631 bp, Homo sapiens
atggagccaaagacaatcactgatgctttggcttctagtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggytttcagcyttaccgccgacctttaaattttccactcaggatatttctgttgattgtcttcatgtgtataacattactgattgccagcctcatctgccttactttaccagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatgatcatgaagactttgatagttgcggtgctgttggctggagttgtccctctccttctggggctcctgtttgagctggtcattgtggctcccctgagggttcccttggatcagactcctcttttttatccatggcaggactgggcacttggagtcctgcatgccaaaatcattgcagctataacattgatgggtcctcagtggtggttgaaaactgtaattgaacaggtttacgcaaatggcatccggaacattgaccttcactatattgttcgtaaactggcagctcccgtgatctctgtgctgttgctttccctgtgtgtaccttatgtcatagcttctggtgttgttcctttactaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaacaaaatgtatattaatttattaaatctagttgtcactttaaaaaaaaaaaaaaaaaaactcgaggggggcccggtacccaaat

SEQ ID NO: 98 - DNA, 504 bp, Homo sapiens
ccgagctgggcgagaagtaggggagggcacgagccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggatattatcaactcactggtaacaacagtattcatgctcatcgtatctgtgttggcactgataccagaaaccacaacattgacagttggtggaggggtgtttgcacttgtgacagcagtatgctgtcttgccgacggggcccttatttaccggaagcttctgttcaatcccagcggtccttaccagaaaaagcctgtgcatgaaaaaaaagaagttttgtaattttatattactttttagtttgatactaagtattaaacatatttctgtattcttccaaaaaaaaaaaaaaaaaa

SEQ ID NO: 99 - DNA, 1416 bp, Homo sapiens
ggcacgagggagggagccctctccgttgggtgactcttgtgtgccctttagacaggctggcctgccggttccacagggtacagttaggacttgagtctttctttttctgttttgagttggtgagtgagtgatagggtaacatgggccttcaggatgaccccttggaactgtgccgagttccttaaatctcagctgggatcctggacctgggaggcccctgtgagggccagctctggaaaaacctgggagttgatgccggagctgtggaagaactctgctcgagggcagggtgccctggaacactggtagttctggggctgggagggagaggggctccggctttctctgaaatgaacactgctcttcagcagttcaagtacttgttctcaaaacattttctaattgattggtaggttttcataagcattgtttctttaaggcatggaaagggaagaatgctcaagcaagtcatgtttgttttcagtgggatgggcccgcgttctcactgctgggggcttccccttcatgtggcacctttgtgcaggggccaccaggcagactcttcccaccttctcccactgaagcaccaaggggcttggaaccgtaatttggctaatcagaggcattttttttgtcctagtatctttcacacttgtccaaccgtcttatttttttaaaagttctgttgcttgtattaacacgaaactagagagaaatagtttctgaagccagtttattgtgaagatccccaaggggaggttcggtagagaaaaatagtaagctggtttagaaactgacgagggcaaacagccaggacgcattggagaggaatttgccaaagatctaccctgagataacgcctgtccagtgtcttcaccacgtgaataaccagcgctccaaagtgtttttctgctttgaaaaaaaaaattccacaagcttttaaaggtgcatttaagaatccatgtgactttagaatggaactgccggccctggcaactgtcacgtgtgctagaaggttcgatgcctctggaatgcatgtgatactcatctccattttgtttccttgattgcatttttgttcttttagcagatctgtccctgtgggtggtgtctaagaagtcggacaccttggtttttgtgttagattgagctgggcagctgcaatcagcttctttatatgcaaattaggcacgacccatctgtggttcctggttggtggctaatgaagtgaggggagggagggatgtcaccccaaaagtaggccctcccattggctttggccaggccagacacttcacatcgtttacatggttctgtgtaattttaaagtttatgtgtataaagcgaagctgtttctgtgaaactgtatattttgtaaataaatatattgctacttgaaaaaaaaaaaaaaaaaaa

SEQ ID NO: 100 - DNA, 2847 bp, Homo sapiens
  SITE (382): n equals a,t,g, or c
  SITE (2146): n equals a,t,g, or c
  SITE (2820): n equals a,t,g, or c
  SITE (2821): n equals a,t,g, or c
ggctaggacaattttggtgctttacctatctctgcaaagactggagaatttggcataccattaattacaaccaccaatcatatccaacaaaagtaccctaaaagaaggaccagtggccactctcgaaaaaatttaagtatcagaagattaaaaagattttaggatttggaagcttgtattgtctttccccaataatcattgtttgatctccaaatagtagccttatattagcaatrgacagatcattggttctccatatctgatcatatgttactactttggaatcagtatttgggcaaattcaagcatttatgcagtggatataaatggaaatataaaaatatttgccaacctgtctcagtaacttatcatatctctgtgnatcctcaaggaaagcacttttgcttttacttagaaagcgtttcagatttgctttatagactcctgctgtcttcagtacctgataaaactttaaccagggaagcattaaacacagtgcagcagcttttgcccaggcttctaagttcctgccggcagcatttatcaatgtaagaactaggatgcttcctgcagtggcactaccttcccctagagctggagcatgctgcttggccttaagccccagcatgatgaggcttccctcctgccaggtcagtaaaagttagagagctcagaattgggtcttgcctgggtgcaggtggcagggtttgctgaaacccctaaagagaagtcaccaagggaggcaggtaatgaatgtttccagaatcagtckgatactcatagcaatttctggctatctttcaaatgttgaatttctggatgctgagagggactttgatttgatatcattaaatccaggacagtcccaagaagtgcttggagtctcggctctgacagcccaagaagggaaataacttgtattaaggaacaactatgagccaggccctgagctgtctcttagataataaaacagatggggagtggaagagtcatttgcttcaagttatacagctaggaaatactcaagccaaatcttgaacgcagctccccctaattctgtggacaggcactttgtaccacacaccatggtccacctaaaaacagaaggataaaaagacttcaggttttcccactgtgtgctgaccatcccaatttatgaatcttcttcaaaatgacatttcacagttatagttagggctcagaaatggcattgaggtagccttatttctcccctttagcagatgctttaagtacacattgctgacttgagcccacccccaggagttaggagaacatttcctttttcatgccatcttccataaataaggtgtttcttggccttcaaagatatagaactttgcagcagtagtaaaagtgaagggtgttctgctctctactcaactttatttgaaaatgtctgcagcttcactcctgtagaaaaggaaatcttcatattttagtaaacttagccgccagtgtactctgtgaggatgtggcaattcaaagtccagtgaatctggctctcttactgattcctggttttagtgtgtgtgtcgggggagtgtgtacctatatataaaggacaagtgtgatatgtgtgtatatgtatatacatacatacatgtccacacacacacacacaatatttgagagctaaggaaaactcaaagcagccccttcattatcttgcgtactacttcaaagatttctgtcagccctaattacaagtgtcaccatatagttggggcttaggtacttgcttacaggaagagcaattccctagcaaaggtcattagctcctaaggcactgagtcaaagtgacagccctgaaggaaattgcactccagccctcctccaggatgtctaataagatgggaaacttggatgcccagccattttggtgacctgagagtctaactactccagttagacctaagggcacaaatgcagaattcatgaccttgtagttgtggcagggtctaggaagtcctctctccccaagtagaaaatattctcttgccattcctgaaattccacattcatataatggctgtgcaatacatgcttctcaataagaaaattaactgcatgtttactgtgtgctgatcacatcagatttttatgtttaaaaaaatctcattatggnttgagtccagcccagctctaagagaaaaagaaggcccatatgggagacttcagtctcattattattgcctttatccagcagtgcttatraagccccctaccctgtcccattccagaaaccataagactcaggcagttcttgattctggaggcctgcctggtaagataagatagtataatttggaactgagaacataccagaaacagcagaacgagggccagagcagaaaaatgaaaataagtggagacacttatggatacattggtgcaaaaaaagccacgggscccatactgggcttgatatgactttgaggggacagcagattaatacttaatgagggttaaacctgaccagtctttctacagtgacaggccacactgcatgaatggggagaaccaatgaatccattgtcctctgcctattttcctgtgcacagtcacattccctccttaggaatcttccccttccaccctttacattaaacaagggaacactgaatctttcaagggaattacacgtttgggttaatgtttcagtatatcattttcatactgtaaattattttgtaagagagatttactgctatcccaggatgttcggacttggtgcccctgtgcatttggaaatcaataaactattactggaaatgccaaaaaaaaaaaaaaaaaaaaaannaaaaaactcgaggggggcccgtaccc

SEQ ID NO: 101 - DNA, 1394 bp, Homo sapiens
  SITE (901): n equals a,t,g, or c
  SITE (904): n equals a,t,g, or c
  SITE (1358): n equals a,t,g, or c
gagattggtggaggagagtaaataatctagaggcaagagttcagtgagggccaagggggacccccagaaaaaggtatggagctaactcatctcttttacaaggggtggccatgacttactgttgcaaagtactcagtgtatatttaatgttgattgttgaattttagttacgagagggaagaacaattttacttctgtccttatttcacttgctgaaaagctgtgggacaaaatgtatggaatagacaaggccactttctttgtgatttctgcttttcatgcatattattttatttacccataatttccaagaggtttggcgttccgctctcctgcttttttctttcatccacccctttcctttttttggaagggggttatatatgagagttcattgaagaagtccagtgaggctgaagtaaaggggcaagatagggcagttaactaaagagcactttatttctttgaagcctttctaagaaagaaatgggggtgcgagtggcttgaatctcccatgatgttggagggcacttagtggggttgaagtatgacataatatttcccattggggaaaggagaatttctcttagagggtggcaaaatgcctttgcccagtgtccctattttaggcatcttttccttccttattccttccagtcagggtgtgtcctatacaaaacttcccatcagttctcctcaatattccccatttgtaaatgatcacttctcttttctaaacccttttcctgttcagatccatacaggatttgcaagggtaggatcatacatgcaaatgccccttgttcatctgtgtcttctgcaaactagtctcatgaagaattctggcgtgcagcagggtagctgaagtttgggtctgggactggagattggccattaggcntcnctgagattccagctcccttccaccaagcccagtcttgctacgtggcacagggcaaacctgactccctttgggcctcagtttcccctccccttcatgaaatgaaaagaatactactttttcttgttggtctagcattgctggacacaaagtgtagtcattattgttgtattgggtgatgtgtgcaaaactgcagaagctcactgcctataagaggaaataagagagaaagtggaggagagggacaaaaggagtaattatttggtatagatccacccatcccaacctttctctcctcagtccctgctcctcatgtttctggtttggtgagtcctttgtgccaccacccataatgctttgcattgctgcatcctgggaagggggtatatggtctcacaagttgttgtcattgtttttttgcatgctttcttaataaaaaaaaaaaaaaaatgtttanagttttatcttaaaaaaaaaaaaaaaaaaaaaaccc

SEQ ID NO: 102 - DNA, 794 bp, Homo sapiens
ggmrcgaggcggagtaaagggacttgagcgagccagttgccggattattctatttcccctccctctctcccgccccgtatctcttttcacccttctcccaccctcgctcgcgtaccatggcggagcgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggacacgctgatcatgctgctttccctggcagctttcagtgtcatcartgtgggtttcttamctcatcctggctcttctctctgtcaccatcarcttcaggatctacaagtccgtcatccaagctgtwcagaartcagaaraaggccatccawtccaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatcccaagcaaaa

SEQ ID NO: 103 - DNA, 1544 bp, Homo sapiens
  SITE (1534): n equals a,t,g, or c
  SITE (1536): n equals a,t,g, or c
  SITE (1537): n equals a,t,g, or c
tttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagccatctcctgtcaggtaggaatgaacttgccagccttcaggytcgttcagctatgaccatctgtgcggtcagggtacactcagctctcctccccaactccagcagcctttaagaagtgtccctttggcgccccctggaggcagagcactgagctggaccctgggtagactcccacagggaggacggagctggcctcaggagtgggacacccagacttggcagggccttcaagaggcctgtgtgggggccccaggaatccttagctgaagcggggagactcactctccatctcaggaaattctagcccttgccctcagggagccacggttgagggtgaggcccaacacctgccttagggccctgggtgggcaagtctgggccctggggtagggagggagactcaggcccacacttgggtattttctaatttcagacaaacacacactcagcgcgcactcactgattcctacacattgccaagatttcacacatgtgaccaggggccaccaaagtccctgtgacctttgtgactaggatcctaatttctctattttctcctgggtgcctgggtctgtgtcacctggggcagtgtggataatgtttagttctgtgacactgttttttgggggtggcacctggttctccgatgcctgggctggtgtcaggcccaggactgtagtgctgggagcagtaaagctcagctctgtgtaatgagtgatgctatggcttgctcgtgtcttatgatccaatccttttctacatcagcccttgttttgttttatggctagtcttatctggcctggttatttccttgcggggaggagagggtttgctaatctgctcccagcccaacctattaccaccccacctcgctgggacctactgctcgggaggcagcagacagggagccaccagcagtggcttcctggccctgtgctgggggtggggggaagctgggggcacatgtggcccttgccttctgagcagctcccagtgccagggctttgagactttcccacatgataaaagaaaagggaggtacagaagttccaattccctttttattttgctggttggtatctgtaaatgtttaataaatatctgagcatgtatctatcaacgccaagaatttcaaagtctccttcaacaatatgaggcttttaggatgtttatattccttcatccctcttgtttcccaggttttgcagggaaaaaaagtctggaattatagatacagcttattattaaatttgttcttgcataaaaaaaaaaaaaaaaaacncnnggggggg

SEQ ID NO: 104 - DNA, 871 bp, Homo sapiens
  SITE (14): n equals a,t,g, or c
  SITE (676): n equals a,t,g, or c
acccacgcgtccgncttgtccacccgggggcgtgggagtgaggtaccagattcagcccatttggccccgacgcctctgttctcggaatccgggtgctgcggattgaggtcccggttcctaaggtgggtcgctgtccacccgggggcgtgggagtgaggtaccagattcagcccatttggccccgacgcctctgttctcggaatccgggtgctgcggattgaggtcccggttcctaacggactgcaagatggaggaaggcgggaacctaggaggcctgattaagatggtccatctactggtcttgtcaggtgcctggggcatgcaaatgtgggtgaccttcgtctcaggctttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtgggagaaggagcgaggcctgggtggggaggtaccaggcagccaacaggttcccgatccttaacgccagntgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttcttcagaaaaaaaaaaaaaaaaaa

SEQ ID NO: 105 - DNA, 404 bp, Homo sapiens
  SITE (366): n equals a,t,g, or c
  SITE (371): n equals a,t,g, or c
ggcacgagttatagcatggcattcatacttttgttttattgcctcatgacttttttgagtttagaacaaaacagtgcaaccgtagagccttcttcccatgaaattttgcatctgctccaaaactgctttgagttactcagaacttcaacctcccaatgcactgaaggcattccttgtcaaagataccagaatgggttacacatttaacctggcaaacattgaagaactcttaatgttttctttttaataagaatgacgccccactttggggactaaaattgtgctattgccgagaagcagtctaaaatttatttttttaaaaagagaaactgccccattattttggtggggttggtttttaatttntaatntgaaaaatttttttggggtttttggggccatgg

SEQ ID NO: 106 - DNA, 1542 bp, Homo sapiens
  SITE (1477): n equals a,t,g, or c
gtcagacaggtggagccgccggggcaggagtctcaaagagccaggctccaggagaggaagggctctrcgagaggagagaggagagcgctggagaggagaggctggagagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaaccanaaaaaaaaaaaaaaaaaactcgaggggggcccgtacccaaatcgccggtatgatcgtaaacaatc

SEQ ID NO: 107 - DNA, 2327 bp, Homo sapiens
  SITE (10): n equals a,t,g, or c
  SITE (2323): n equals a,t,g, or c
ggtagctcantgcagtgaaatagtcttactggaaacaaagccctttatcaagaataattaactcttcccttttctttttggagaggtgctttgtttctgatcggaccatttcactgcagcaagcaacacagtattctragcagaagatcgggacttgaggccatgttgcggagggccagtracattatctggactctggagtgtgaggaatatggactccactcttcactatattcacarcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgrgactytggcctcagacatgcagtggaaagttcgacggaactctagcattctccatccacgrgcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaakgkkwawkmmwwkctcagmsrattatamttswcwmmrargsmwymaawsctkswgctcywccksrstgrmkgmmrctctagaaytrgyrgakcmyyyksgctkmwggaakksggcasgagccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatctatagagagagatatatacacttttgattgttttctagatgtctaccaataaatgcaatttgtgacctgtaaaaaaaaaawaaaaaaactcgaggggggcccggtacccaaatcgccgatatgatctaancatc

SEQ ID NO: 108 - DNA, 1062 bp, Homo sapiens
  SITE (57): n equals a,t,g, or c
  SITE (605): n equals a,t,g, or c
  SITE (1031): n equals a,t,g, or c
ggccgccgaggcgcaacagccgttctgtcagctctgggtccaaccggactagcgaanatcttcctcatcctcatcatcgtcttcctcatcccgatctcggtccaggtccctctcccccccacacaagaggtggcgaaggtccagctgtagttcctctggacgttctcgaagatgctcttcctcttcttcgtcatcatcttcctcttcgtcttcctcatcctcatcatccagttctcgaagccgctcacgaatccccatccccccgccggagraagtgacaggaggcggcggtacagctcttatcgttcacatgaccattaccaaaggcaaagagtgctacaaaaggagcgtgcaatagaagaaagaagggtggtcttcattggaaagatacctggccgcatgactcgatcagagctgaaacagaggttctccgtttttggagagattgaggagtgcaccatccacttccgtgtccaaggggacaactacggcttcgtcacttatcgctatgctgaggaggcatttgcagccattgagagtggccacaagctgcggcaggcagatgagcagccctttgatctctgctttgggggccgaaggswgtnctgcaagaggagctattctgatcttgactccaaccgggaagactttgacccagcacctgtaaagagcaaatttgattctcttgactttgacacattgttgaaacaggcccagaagaacctcaggaggtaaccttgggcccttccctgctatcctttttctcctttggaggtgcccaacctcctccacccccttcccctactctaggggagagagctgctagtgagatgactgttttataaagaaatggaaaaaagtgaaataaaaaatatgttgaatcagattttttaaaaggggtatttgtttttttataacaggtattgaaacaagttaacttgcattcctatgtaagataggaggggctgaggggatccccagtgtttggaacataagtcactatgcagactaataaacatcaactagagagnaaaaaaaaaaaaaaaaaaaatttaaaaaact

SEQ ID NO: 109 - DNA, 2539 bp, Homo sapiens
gagagactcacacttcttttccattatcactgacgatgtagtggacatagcaggggaagagcacctacctgtgttggtgaggtttgttgatgaatctcataacctaagagaggaatttataggcttcctgccttatgaagccgatgcagaaattttggctgtgaaatttcacactatgataactgagaagtggggattaaatatggagtattgtcgtggccaggcttacattgwctctagtggattttcttccaaaatgaaagttgttgcttctagactttyaagmkmratwkccccmakywawckgaacamamkctgswcytccwsygcsktrrmkrycgykstatrrcwarwksakymccygkkmtgsrrgtawytsktgcaykagggaacaattgaggaagtttgttcttttttccatcgatcaccacaactgcttttagaacttgacaacgtaatttctgttctttttcagaacagtaaagaaaggggtaaagaactgaaggaaatctgccattctcagtggacaggcaggcatgatgcttttgaaattttagtggaactcctgcaagcacttgttttatgtttagatggtataaatagtgacacaaatattagatggaataactatatagctggccgagcatttgtactctgagtgcagtgtcagattttgatttcattgttactattgttgttcttaaaaatgtcctatcttttacaagagcctttgggaaaaacyycmaggggcaaacctctgatgtcttctttgckkmmsrtarmttttgayatrmaryactrmmtksaytyaaygrwgtgacwsgawaatattraastytatacaatkaatywtrryttsmkrmagmyaatccgaaaytgtggmaamyaaacttgatattcaaatgaaactccctgggaaattccgcagagctcaccagggtaacttggaatctcagctaacctctgagagttactataaagaaaccctaagtgtcccaacagtggagcacattattcaggaacttaaagatatattctcagaacagcacctcaaagctcttaaatgcttatctctggtaccctcagtcatgggacaactcaaattcaatacgtcggaggaacaccatgctgacatgtatagaagtgacttacccaatcctgacacgctgtcagctgagcttcattgttggagaatcaaatggaaacacagggggaaagatatagagcttccgtccaccatctatgaagccctccacctgcctgacatcaagttttttcctaatgtgtatgcattgctgaaggtcctgtgtattcttcctgtgatgaaggttgagaatgagcggtatgaaaatggacgaaagcgtcttaaagcatatttgaggaacactttgacagaccaaaggtcaagtaacttggctttgcttaacataaattttgatataaaacacgacctggatttaatggtggacacatatattaaactctatacraktamgtcagmgctyyctacakayraytcmswawmtgtggaaarywsstamgmswgcwkktammrrtmcggmwwtyyymkrktygaymywygcgwmcgagaaaaagccgtaaggtgtatgtagaccacttaatcactaaatatctttgcctataggactccattgaatacattagccattgataatctacctgtttaaatggcccctgtttgaactctcaagctttgaagacctacctgttcttccagaagagaacgttgaaagtgccatgtttccttttgcgtgatctctgttgatggcactctggaattgtttccagtttaaktcattttagacatagcatttattatcactgtggatctctacttgttgggtgttatgaattctttgaagaatatattttgaagaggtgtgggaggaaggaatacattttataaaatgttgtagtgaagcccacaattgaccttkgactaataggagttttaagtatgttaaaaatctatactggacagttacaagaaattaccggagaaaagcttgtgagctcaccaaacaaggatttcagtgtagattttgtctttcttgaacttaaagaaacaaatgacaaagtttgaatggaaaagcctgctgttgttccacatctcgttgctgtttacattcctttgtggagcctacatcttcctaagctttttagcaggtatatgttgaacacttctgtttcatggttgagacagaatcagaggccatggatactgacaactgatttgtctgttttttttctctgtctttttccatgactcttatatactgcctcatcttgatttataagcaaaacctggaaaacctacaaaataagtgttgtggtttatctagaaaaatatggaaaatattgctgttatttttggtgaagaaaatcaattttgtatagtttatttcaatctaaataaaatgtgaattttgttwwattaaaaattwggsacaaabtbghgggggdtccaaachtwvtcghgkaamttctctwaarmatytkataaacmscttcacaattc

SEQ ID NO: 110 - DNA, 1751 bp, Homo sapiens
agcatgaagccgatggccgtggtggccagtaccgtcctgggcctggtgcaaaacatgcgtgcgtttggcgggatcctggtggtggtctactacgtatttgccatcattgggatcaacttgtttagaggcgtcattgtggctcttcctggaaacagcagcctggcccctgccaatggctcggcgccctgtgggagcttcgagcagctggagtactgggccaacaacttcgatgactttgcggctgccctggtcactctgtggaacttgatggtggtgaacaactggcaggtgtttctggatgcatatcggcgctactcaggcccgtggtccaagatctattttgtattgtggtggctggtgtcgtctgtcatctgggtcaacctgtttctggccctgattctggagaacttccttcacaagtgggacccccgcagccacctgcagccccttgctgggaccccagaggccacctaccagatgactgtggagctcctgttcagggatattctggaggagcccggggaggatgagctcacagagaggctgagccagcacccgcacctgtggctgtgcaggtgacgtccgggctgccatcccagcaggggcggcaggagagagaggctggcctaacacaggtgcccatcatggaagaggcggccatgctgtggccagccaggcaggaagagacctttcctctgacggaccactaagctggggacaggaaccaagtcctttgcgtgtggcccaacaaccatctacagaacagctgctggtgcttcagggaggcgccgtgccctccgctttcttttatagctgcttcagtgagaattccctcgtcgactccacagggacctttcagacaaaaatgcaagaagcagcggcctcccctgtcccctgcagcttcggtggtgcctttgctgccggcagcccttggggaccacaggcctgaccagggcctgcacaggttaaccgtgagtctgtctcatctattcacagctgggaatgatactaatacctccgattttagcccagcaccacagggtacgttccagtttttctctctttccatagctgtaaggccctttctgggaatggttctcattctccttaatctattattgggtcagttttcctgcatgtccccagcctcccatcactgccacccactccccacagagatgccctgctcatccgactggggctttgactcccacactgtgtacccctcttgtgtggacgccctgctgccaaaaccttcagcaaacagctttccaaatggaagttgtcactgtcaggcctttacaatcagcaacagcaaaatctacatgctgctgagggtcctgcctcattaagatgcaataaatatgtaagtacataaaaacagcaatagaagaaacgtaatgctttattctcaaatatgatgtctacatagaaaagccaaaattattaagaatagtaagaattcacccagcactttgggaggccgaggcgggtggatcatgaggtcaggagatcgagaccatcctggctaacagggtgaaaccccgtctctactaaaaatacaaaaaattggccgggcgcagtggcgggcgcctgtggtcccagctactggggaggctgaggcaggagaatggcgtgaacccgggaagcggagcttgcagtgagccgagattgcgccactgcagtccgcagtccagcctgggcgacagagcgagactccgtctcaaaaaaaaaaaaaaaaaaaaaaaaaa

SEQ ID NO: 111 - DNA, 1117 bp, Homo sapiens
aatgttgtggtggtagcatttgggttaattctrattatagagtctcttggagagcaatgtccataaactaatcccaaacaacattgtctttttratgttgtagtgaacagcagagaatttcaaaggaccttgctaatatctgtaagacggcagctacagcaggcatcattggctgggtgtatgggggaataccagcttttattcatgctaaacaacaatacattgagcagagccaggcagaaatttatcataaccggtttgatgctgtgcaatctgcacatcgtgctgccacacgaggcttcattcgttatggctggcgctggggttggagaactgcagtgtttgtgactatattcaacacagtgaacactagtctgaatgtataccgaaataaagatgccttaagccattttgtaattgcaggagctgtcacgggaagtctttttaggataaacgtaggcctgcgtggcctggtggctggtggcataattggagccttgctgggcactcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttaaatttaaatacatacttatgtttgtattaatctatcaatatatgcatacatgaatatatccacccacctagattttaagcagtaaataaaacatttcgcaaaagattaaagttgaattttacagttaaaaaaaaaaaaaaaaaaaaaaaa

SEQ ID NO: 112 - DNA, 1313 bp, Homo sapiens
ggcagaggttttcttatattttaagtaaatttaaagtggctatcagaatatttattcttgtttgagactaccaacataactacgtgttgaaggtgcttcacagagaatatattgcctttaatgtgaaataattttcaccaatgttgctaactttaataaagtataaaatttgtagaatattcagttaagtagttggtaacccttttctattttagtaaaacttaatgcatgtttacttttttttgaaagatgcagacaatctctttgaacatgaattgggggctctcaatatggctgcattactacgaaaagaagaaagagcaagtcttcttagtaatcttggcccatgttgtaaggcgttgtgcttcagacgggattctgcaattcgaaagcagcttgttaaaaatgagaagggcaccataaaacaagcttacacgagtgctccaatggtagacaatgaattacttcgattgagtcttcggttatttaagcggaagactacttgccatgctccaggacatgaaaagactgaagataataaactttcacagtccagtatccaacaggaactgtgtgtgtcttaagaccgaagttacaatatggtatttttggtactgtcttccttcagcagtgcatattcttttgcaaagttctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttgggatgtcttttgaccctaaatgctttttttgttatcagagattgtgtactatttttatttttaataaatgtatcttcccttttmaaaaaaaaaaaaaaaaaaaaaaaaaaaaaaaaaaaaaaaaaaaaaaa

SEQ ID NO: 113 - DNA, 1654 bp, Homo sapiens
  SITE (549): n equals a,t,g, or c
  SITE (552): n equals a,t,g, or c
  SITE (1641): n equals a,t,g, or c
acagggacagaatactttctttccttccttcaagtacaagaaggctttctctaccatttgcgtctacactttattttaaaagctatccttttctagtagtattttatcatggcaatggcatgatgacaacaacagtctttcattacagactgaagggaagcatgtccttacttaaaatagttctgctactttccctcctattataaggaaattttacagattctaaaaataccttaatttttctttgatttttattttaccaagtcacaaatgtctttttgatgttttgagaattgttctcatagaatcacaaatactgacatttcattagatgattattttcctagaatccccaaagagcagtggcagtccatggcttggttgaagctagaaattttcctgcccctggtgacctggtaagcctcctgctcggaaccgtgtgagtgggtgaggaagatgagagatggtcagatggaagagagraatacatgaactgctctggcctctctggttctgttcttggcccagagtttttgaaaagcagcgganatngactgacttcacatgctcagctttctcagccttttgtttattttgttgtccttagatttccctgttgtaaaaggggcaagaaaagtaactcatcatctctaacacaccatggcagcttagccaggtagtcttagtggtggtgtttaggcataagatatgctgatcatcagtctcaggccacagtttccttcactaatcgtccagcttgagtgttctgttctcttcctgcccatttccttgaacctcctgctctagccttggcggagggagagtgctatttgcttttgttctccctctgtcttaggaaaagccatctttaatatagttcttcaccactgttggggttgttttgtgattttttttttcttccgaagaactcctggttgttattggattttgtattttaatacaaattattgaattttataagcttgtacacaatatttaattagtgtgaaaggaaacaaagaatgcaggaaaaataatttaatatcaacctcagttgacaaggtgctcagattattcaattcgggatcctccttttgttaggtttttgagacaaccctagacctaaactgtgtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatacatccattcaaaattatgcaagttagtaattactcagggttaactaaattactttaatatgctgttgaayctactctgttccttggctagaaaaaattataaacaggactttgtagtttgggaagccaaattgataatattctatgttctaaaagttgggctatacataaattattaagaaatatggatttttattcccaggatatggtgttcattttatgatattacgcaggatgatgtattgagtaaaatcagttttgtaaatatgtaaatatgtcataaataaacaatgctttgacttatttccaaaaaaaaaaaaaaataaanttcgagggggggc

SEQ ID NO: 114 - DNA, 1171 bp, Homo sapiens
  SITE (18): n equals a,t,g, or c
  SITE (69): n equals a,t,g, or c
ggcaaactttcccccaangcttcgaaacttgcaagccgaaaccttgaatcgttaaaagttgggttgcgncggcgccctggcccgaagaagcgcaattggcgttccgcgaacgttggccctcaacggctcggcagccagccatgtcctgcacccaggacagcggccctgggctacaaggacctggmcctcatcttcctgcgccgacctgcgcggggtaaggggwagtttcagactgtgaaggacgtcgtgctggactgcctgttggacttcttacccgagggggtgaacaaagagaagatcacaccactcacgctcaaggaagcttatgtgcagaaaatggttaaagtgtgcaatgactctgaccgatggagtcttatatccctgtcaaacaacagtggcaaaaatgtggaactgaaatttgtggattccctccggaggcagtttgaattcagtgtagattcttttcaaatcaaattagactctcttctgctcttttatgaatgttcagagaacccaatgactgagacatttcaccccacaataatcggggagagcgtctatggcgatttccaggaagcctttgatcacctttgtaacaagatcattgccaccaggaacccagaggaaatccgagggggaggcctgcttaagtactgcaacctcttggtgaggggctttaggcccgcctctgatgaaatcaagacccttcaaaggtatatgtgttccaggtttttcatcgacttctcagacattggagagcagcagagaaaactggagtcctatttgcagaaccactttgtgggaattggaagaccgcaagtatgagtatctcatgacccttcatggagtggtaaatgagagcacagtgtgcctgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagagaaaaaaaaaaaaaaaaaaaaaaa

SEQ ID NO: 115 - DNA, 842 bp, Homo sapiens
  SITE (834): n equals a,t,g, or c
  SITE (839): n equals a,t,g, or c
ggtctgcgccggaagtgcatgagctgccgatgtggtgcttagtgattgcggtttcggtcgctctcccgtgtttcccgggctgggtatttgcctcgcaccatggcgcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcagggcatggcagagcaccttaaggatgtgatcctactgacagccatcgtgcaggtgctcagctgcttctctctctatgtctggtccttctggcttctggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaataaatggcttagaatgtgaaaaaaaaaaaaaaaaaaaactcgaggggggcccggtacccaatttcncctanaat

SEQ ID NO: 116 - DNA, 1640 bp, Homo sapiens
ggcacgaggcggcggcagcggtggcggcggcgccccccggcgggagccgttccctttcccgtcggggagcgcggggycggggcccaggggaccccgggccacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagggtaaaccagacttgaaatacaacattgccaattagacaaacagcatcaattttcaaacaaccggtaacccaaagtcacaaatcatcctagtaataaagtgaaatcagacccacaacgaatgaatgaacagccacgtcagcttttctgggagaagaggctacaaggactttagtgcatcagatgtaacagaacaaattataaaaaccatggaactacccaaaggtcttcaaggagttggtccagtagcaatgatgagacccttttatctgctgttgccagtgctttgcacacaagctctgcgccaatcacagggcaagtctccgctgctgtggaaaagaacctgctgtttggcttaacacatctcaacccctctgcaaagcttttattgtcacagatgaagactcaggaaacagaagagcgagtacagcaagtacgcaagaaattggaagaagcactgatggcagacatcttgtcgcgagctgctgatacagaagagatggatattgaaatggacagtggagatgaagcctaagaatatgatcaggtaactttcgaccgactttccccaagagaaaattcctaggaaattgaacaaaaatgtttccactggcttttgcctgtaagaaaaaaaatgtacccgagcacatagagctttttaatagcactaaccaatgcctttttagatgtatttttgatgtatatatctattattcaaaaaatcatgtttattttgagtcctaggacttaaaattagtcttttgtaatatcaagcaggaccctaagatgaagctgagcttttgatgccaggtgcaatctactggaaatgtagcacttacgtaaaacatttgtttcccccacagttttaataagaacagatcaggaattctaaataaatttcccagttaaagattattgtgacttcactgtatataaacatatttttatactttattgaaaggggacacctgtacattcttccatcgtcactgtaaagacaaataaatgattatattccacagaaaaaaaaaaaaaaaawmwstygarrrgsrgcmcrswaymmarwwccccwmrtwrgsmktcstmtkayttacattcaactctgatcccggggccttaggtttgacatgggaggtgggaggaagatagcgcatatatttgcagtatgaactattgcctctgggacgttgtgaggaattgtgctttcaccagaatttctaaggatttctggcttaaatatcacctagcctgtggtaattttttttccct

SEQ ID NO: 117 - DNA, 952 bp, Homo sapiens
  SITE (10): n equals a,t,g, or c
  SITE (951): n equals a,t,g, or c
  SITE (952): n equals a,t,g, or c
tgaatttagnaaacactttggaaaactcataacctcatcagaaactgcctttagccacactcctgaccttctagatgagtaacaaaaaaatgaaataagttcttggaaattaagccatttattttaatttgctatttttttcaatgttctaggtatctttaaatttgttattgtggaatcattttcctgccagatacctttatcaaaattattggcctcatgagagctgaagtaagtcagctttttggtgaactttagtggacttctgtgagattgtagttgtactttgtatctctaaatctaaagatagttttttaaaactcccaaagaaaatctgctctcctttctgatctaaaaactcatctttggggtaaagagttaagtgtccaaaggttgtcacagttcatgaggtcagagggagctagcctggcacctggactctgcccatccacagctgacagattccaacagaagtgtatttaaattctccagtagacaatgctgggtaagggagggggtagggctgggttattaagatacaggctgctgtattttacattggttgtgggggaaggggagcctggagaaaacaaagtcactattcccttttttgaaacaggaaaaaaaattattttttgttcagtaaaaatggtagagaattccaatgtccctagccacaagggaccagttccactgagaagtgaacagtgggaactcaaaatttcagaaacattgggggaagggaaaattggctttctcttaattggcagatgttccagtggggsgggggggctctgtttttgttgggatgtgttatgttgtatgtacgcatatatggaccggagtctgctgagtttataaggttccaaaaatatggtaaaatcttggtttttgttaatttatctcaataaaagcccactggractccaaaaaaaaaaaaaaaaaaaagann

SEQ ID NO: 118 - DNA, 1256 bp, Homo sapiens
  SITE (1222): n equals a,t,g, or c
gacgtcataggtaaacaggctctgtatccgtggcagcggccgtggcaggctggctgggtaccggctgtcgctgacccaggagaagctgcctgtctacatcagcctgggctgcagcgcgctgccgccgcggggccggcagctgaactatgtgctcttcagggcgggcaccgtgttgcattcatctttgtacccccagcatctagcagtgttggcatgtagtaggcactcaagaaatgtgtgttgaatgaacgatgcctgtgacaagcaagcggactttattctttcctgacccttgctcctatgacacacctcctcctgactgccactgtcactccttcagagcagaactcctctagggaacctggatgggaaacagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatggcttgatgtaccttttttcctgttgctcttgaaatatgtttaactcctcatgagagaaccctggattctctatcccctagtccacaaaacaaaccaggcagtggtcagcagctacctttnatttggatcacacacgtgagtcagacagtaccac

SEQ ID NO: 119 - DNA, 1143 bp, Homo sapiens
  SITE (1139): n equals a,t,g, or c
  SITE (1143): n equals a,t,g, or c
ggccgtagcagccgggctggtcctgctgcgagccggcggcccggagtggggcggcggcatgtaccttccacattgagtattcagaaagaagtgatctgaactctgaccattctttatggatacattaagtcaaatataagagtctgactacttgacacactggctcgagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattctatattttctggcaagtttctatacgaagtatgatccaactcacttcatcctaaacacagcttctctcctgagtgtactaattcccaaaatgccacaactacatggtgttcggatctttggaattaataagtattgaaatgttttgaaactgaaaaaaaattttacagctactgaatttcttataaggaaggagtggttagtaaactgcactgtttctstgataatgtgaaatgagaagtatttacattggagggccaatggctggtccttcaagtgctgttttgaagtgcagatttccattaaatgatgcctctgtttaatacacctggtacatttctgaagaggggctttataagcaggctgggcaggcccagcttataagttaaagggcatcacagtgagggtgtagtagataaattcaaggaaataagagatttgtaagaaactaggaccagcttaacttataatgaatgggcattgtgttaagaaaagaacatttccagtcattcagctgtggttatttaaagcagacttacatgtaaaccggaatcctctctatacaagtttattaaagattatttttattaccgtaaaaaaaaaaaaaaaaaaaaaaaaaaaaaaaaaaaaaaaaaaaaaaanagan

SEQ ID NO: 120 - DNA, 1782 bp, Homo sapiens
caggccccggccccccacccacgtctgcgttgctgccccgcctgggccrggccccaaaggcaaggacaaagcagctgtcagggaacctccgccggagtcgaatttacgtgcagctgccggcaaccacaggttccaagatggtttgcgggggcttcgcgtgttccaagaactgcctgtgcgccctcaacctgctttacaccttggttagtctgctgctaattggaattgctgcgtggggcattggcttcgggctgatttccagtctccgagtggtcggcgtggtcattgcagtgggcatcttcttgttcctgattgctttagtgggtctgattggagctgtaaaacatcatcaggtgttgctattyttttatatgattattctgttacttgtatttattgttcagttttctgtatcttgcgcttgtttagccctgaaccaggagcaacagggtcagcttctggaggttggttggaacaatacggcaagtgctcgaaatgacatccagagaaatctaaactgctgtgggttccgaagtgttaacccaaatgacacctgtctggctagctgtgttaaaagtgaccactcgtgctcgccatgtgctccaatcataggagaatatgctggagaggttttgagatttgttggtggcattggcctgttcttcagttttacagagatcctgggtgtttggctgacctacagatacaggaaccagaaagacccccgcgcraatcctagtgcattcctttgatgagaaaacaaggaagatttcctttcgtattatgatcttgttcactttctgtaattttctgttaagctccatttgccagtttaaggaaggaaacactatctggaaaagtaccttattgatagtggaattatatatttttactctatgtttctctacatgtttttttctttccgttgctgaaaaatatttgaaacttgtggtctctgaagctcggtggcacctgggaatttactgtattcattgtcgggcactgtccactgtggcctttcttagcatttttacctgcagaaaaactttgtatggtaccactgtgttggttatatggtgaatctgaacgtacatctcactggtataattatatgtagcactgtgctgtgtagatagttcctactggaaaaagagtggraatttattaaaatcagaaagtatgagatcctgttatgttaagggaaatccaaattcccaattttttttggtctttttaggaaagatgtgttgtggtaaaaagtgttagtataaaaatgataattwactkgtagtcttttatgatwacaccaatgtattctagaaatagttatgycytaggaaattgtggtttaatttttgacttttacaggtaagtgcaaaggagaagtggtttcatgaaatgttctaatgtataataacatttaccttcagcctccatcagaatggaacgagttttgagtaatcaggaagtatatctatatgatcttgatattgttttataataatttgaagtctaaaagactgcatttttaaacaagttagtattaatgcgttggcccacgtagcaaaaagatatttgattatcttaaaaattgttaaataccgttttcatgaaagttctcagtattgtaacagcaacttgtyaaacctaagcatatttgaatatgatctcccataatttgaaattgaaatcgtattgtgtggctctgtatattctgttaaaaaattaaaggacagaaacctttctttgtgtatgcatgtttgaattaaaagaaagtaatgg

SEQ ID NO: 121 - DNA, 610 bp, Homo sapiens
gttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcacaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgctacctggtactgctttcagtgtgttccccctcagccctccggcgtgtcaggcatactctgagtagataatttgtcatgcagcgcatgcaatcagaatctcactgagccacccatcattgtgaaataattacctcagttgtacaggacttggtgatcaggatccaggcactcacttgtattctactgctcaataaacgtttattaaacttgaaaaaaaaaaaaaaaaaaaaa

SEQ ID NO: 122 - DNA, 526 bp, Homo sapiens
  SITE (48): n equals a,t,g, or c
  SITE (496): n equals a,t,g, or c
  SITE (501): n equals a,t,g, or c
ggtacgcctgcaggtaccggtccggaattccgggtcgcccacgcgtcnggccacgcgtccacccacgcgtccgsccacgcgtcggagccgagccggactggtcaggatgatcacggacgtgcagctcgccatcttcgccaacatgctgggcgtgtcgctcttcttgcttgtcgttctctatcactacgtggccgtcaacaatcccaagaagcaggaatgaaagtggcgctttctccgccccagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagactttttaaaaaaaaaaaaaaaaanttcgnggggggsccggtacccatcccccta

SEQ ID NO: 123 - DNA, 2081 bp, Homo sapiens
  SITE (1996): n equals a,t,g, or c
  SITE (2054): n equals a,t,g, or c
tgtaccggtccggaaattcccgggtcgacccacgtcgtcsggggaacatggcggctkcggagccggcggtccttgcgctccccaacagcggcgccgggggcgcgggggcgccgtcgggcacagtcccggtgctcttctgtttctcagtcttcgcgcgaccctcgtcggtgccacacggggcgggctacgagctgctcatccagaagttcctcagcctgtacggcgaccagatcgacatgcaccgcaaattcgtggtgcagctgttcgccgaggagtggggccagtacgtggacttgcccaagggcttcgcggtragcgagcgctgcaaggtgcgcctcgtgccgytgcagatccagctcactaccctgggaaatcttacaccttcaagcactgtgtttttctgctgtgatatgcaggaaaggttcagaccagccatcaagtattttggggatattattagcgtgggacagagattgttgcaaggggcccggattttaggaattcctgttattgtaacagaacaataccctaaaggtcttgggagcacggttcaagaaattgatttaacaggtgtaaaactggtacttccaaagaccaagttttcaatggtattaccagaagtagaagcggcattagcagagattcccggagtcaggagtgttgtattatttggagtagaaactcatgtgtgcatccaacaaactgccctggagctagttggccgaggagtcgaggttcacattgttgctgatgccacctcatcaagaagcatgatggacaggatgtttgccctcgagcgtctcgctcrarccgggatcatagtgaccacgagtgaggctgttctgcttcagctggtagctgataaggaccatccaaaattcaaggaaattcagaatctaattaaggcgagtgctccagagtcgggtctgctttccaaagtataggacatttgaagaactggtatgctactcactggtgaaggacagtcaggtgaaggactgtaagcccacacaagctcttcttatctctactagaattaaaatgttaagtcaaaaacggctccttttttgcgcctcctagtgaaacttaaccagctagaccatttgagtaccagcatttagttacaaacgtcaaaggcttccggtgctgcttaccttccttttttgttaatgtgcttttatttattaaaaaaaattacaatgaagatgcctgttttgtctctactgtgtactctgatcgtatctttccaaagtgcagactcttgtgaagttttcttaaattgttcactttaaagaaaatgacgtaccaacaatgatttggcttttatattactgtaagatgttataatgttaatgtggatgtagtgcttttactttacagattgattggaataagattattgcatatgaatttacccacaggactctgaatcatgttacccactcccctcacaatgttgtccacttagtgagttgcattgatctatccgtaccaaatgatgttgaataattacatatctttcttgactatactgatttcttattttggtcactattactaaatctctgttaatattctctcttttaactgaaaagggatgggatagaagggtttgcaatgccatattattggtggagggctgttttaacatctttgaagtatggcttgctgaatatctttaccaacatcttgaatatatattctagtgtccacaagatttagcaaaaagataaagcttgggtggaatatcattttaaaatgttcatgttctgttctatattttcttcacctactctccaaatattgtaatgcaaaaagtctcagtaatgatttggtagtattaattttgtggtcattgtttctcttcgataaatttattttcattaaatacttrttagagggttttgaaatgtttttcaaatatgtgaaatgtgaaactgctgtcttttatattaaagtaattaaagaaaatgtattgtgattgaaattattttgncctccacaagatggctctatgagtattcttccagggattctaatatttatttaaggtnataaaatcttgacatttataatctttc

SEQ ID NO: 124 - DNA, 1717 bp, Homo sapiens
ccccggcggagctggacccgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagacccctggcaaagcrtatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaa

SEQ ID NO: 125 - DNA, 804 bp, Homo sapiens
  SITE (721): n equals a,t,g, or c
  SITE (723): n equals a,t,g, or c
  SITE (730): n equals a,t,g, or c
  SITE (766): n equals a,t,g, or c
  SITE (769): n equals a,t,g, or c
ccacgcgtccggtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggtgcaaacagctgcacagcaagtggcagaggataaatttgtttttgacttacctgattatgaaagtatcaaccatgttgtggtttttatgctgggaacaatcccatttcctgagggaatgggaggatctgtctacttttcttatcctgattcaaatggaatgccagtatggcaactcctaggatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatggtatgaaaactttcaaagacgactagcacagaaccctntnttttggnaaacataatttgaataaaataatttttaatggattntgnaaaaaaaaaaaaaaaaaaaaaaaaaaaaaaaaaaa

SEQ ID NO: 126 - DNA, 431 bp, Homo sapiens
  SITE (277): n equals a,t,g, or c
  SITE (313): n equals a,t,g, or c
  SITE (380): n equals a,t,g, or c
  SITE (416): n equals a,t,g, or c
ggcacagcccagggccttgaagccagctggccctggagaggggctgctgtgccagcttggggagggtctgggatggggctgcccctgatggccctgatgtggagtaccttgccagcatctgctggggtgaactttattttagcccttcccttgttgctcttatggaagaacagaggaggggtgggcaggtcagtgatgtcagcagtggagtgattcccagcacagcggcttctgggaagagggcatggaggcatttctttcagggaaatggtccatnatttcagccagaaggcattgcattaagttaagtccnggacttttgtggcccagctctgtgttattaagggcccttggcgaagacttcaaggagggggcaaaangacctttaagtttttaggtttaacacagggaacccncaaagggttattttg

SEQ ID NO: 127 - DNA, 3752 bp, Homo sapiens
  SITE (1): n equals a,t,g, or c
  SITE (435): n equals a,t,g, or c
  SITE (2186): n equals a,t,g, or c
nggcacgaggagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatastcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacgggggaccttgacctcgtcatgaacctcatggatgcacacaaggttttccagaaggaactggngaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctggatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggttcttcctcggcaatcagtttggggattctcagcagttgcggctggtccgtattctgcgcaaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatnagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcattgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaaaaaaaaaaaaaaaaaaaaaaaaaaaaaactcgaggggggcccggtacccaattcgccgtatatgatcgtaaacaatc

SEQ ID NO: 128 - DNA, 1144 bp, Homo sapiens
tgaccctctgcctgccgggctcagtgctggacgctttctgttttgtcgcagtcggtcctcggtaacaccagcggcctgtggtccaccactccattcagcagctccatttggtccagcaaccttagcagcgccttcccttcaccactccagcaaacacgctggcaagcatcggcctcatgggcacagaaaactcccctgctcctcacgctccctccacctccagtccagctgacgacttgggacagacctacaacccgtggcggatatggagccccacgattggaagaagaagctcggacccttggtctaattcgcactttcctcacgagaattaaattaagcaaaaaacaaacaaacatagtgggccctcgtctagatcatgatgtgccagtttctgagacatctttttaaggctcttactgcagctcccctccccaccctcctcttctttgcaaaacagacccaagcagggcaggctcagaccactcgcttctttcagatctttcttgcaattatgataacatgagatttgctgttgtgcttttagagaaaagtctggactcagccacaaactctaataagacctgtacatctgagaacctttcccgttactgcgttttcaccacctgtcttccccatgctttatttatctgtatgaacacagatttgacattacagctaaggaaataatttgagttgattcagaaatcctggcatgtgacaattttgttaaattaccaagtttggtttttaataatttctcaatattatgcgccaagatctaattttaaaactgtatgaggactttgtgctgaaaatagagtatttttttaaagtaaggctgtcttggtttaaaagcagattacagaaatgtaagtcaacttaagaacrgtgaatgaatgtaaaaacattcagtygagaccatatgcattttctgtgctgtttgtacttgaggtatgtaacatttgtatacctgaacttattttaaagatgaactgaaatgcacatagccaagtcttgagatacaagattgaatgtgtatttcttaaaaatacaactttgtgttgtactttgaaataaatgatgcttttttcaaaaaaaaaaaaaaaaaaaaaaaaactcgagggggggcccggtacccaat

SEQ ID NO: 129 - DNA, 1830 bp, Homo sapiens
  SITE (317): n equals a,t,g, or c
gcatgcagaggagcaccctgagcgtgtycctggagcaggcggccatsttggcacggagccacgggttgctgcccaagtgcatcatgcaggccacggacatcatgcggaacagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccttctccagggatggcccaangcttccgcarccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgttaatattagggttgtaaggtgtcgttttgaggtatcgactgtgattccttcccccaccctccattctccagcggttggccggtgttagaactcgctctctttgagtgactggctacaagggcctgagaggtggccagccagggttggagctggaggggatggagccccacctgaggtgccgtgtcacacgggttagagggtcactgggaaacaccgggcggtggcttctgtgatttattttcttgatggtaacttctcagagcagggcrattgggacatcaccagccagagcacaggaagccaccctgcctgctggggaggagggacccacacaagccccctcggcagtttgtccccccagcttcggtatgccttcagggaaaggtcacagctggggaggaagcggggggacgcctgtcacccctggcaggtggtgagttcaggtgggggctccctgctkcccccaggcctgggagcttgaagccctcccggcatctggcatccgagcctcccgccctccagggtgcgcttccctctcttgccgcagcatacacgagggcaggcagtggccttgtcactgtatcttgcatcagagacaaaggaggacccgctttagccctgctgcgggaaatgggggatggcccagggccagcgcattgtgcactggtttactttaaaatgtacagattcttctcgttaaattcttgatagattttttattatt

SEQ ID NO: 130 - DNA, 1864 bp, Homo sapiens
  SITE (1648): n equals a,t,g, or c
ggccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagckggagatgagttcgagacccgcttccggcgcaccttctctgatctggcggctcagctgcatgtgaccccaggctcagcccaacaacgcttcacccaggtctccgatgaactttttcaagggggccccaactggggccgccttgtagccttctttgtctttggggctgcactgtgtgctgagagtgtcaacaaggagatggaaccactggtgggacaagtgcaggagtggatggtggcctacctggagacgcggctggctgactggatccacagcagtgggggctggttatcccagatcactgaagctgagatggctgatgaagtaatttgcagtgaaattttaagcgactgtgactctgctgcaagttccccagatcttgaggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggggccgggctagagcgacatcatggtattccccttactaaaaaaagtgtgtattaggaggagagagaggaaaaaaagaggaaagaaggaaaaaaaaaagaattaaaaaaaaaaaaaaaaaaaacagaagwtgmccttgatggaaaaaaaatattttttaaaaaaaagatatactgtggaaggggggagaatcccataactaactgctgaggagggacctgctttggggagtaggggaaggcccagggartggggcagggggctgcttattcactctggggattcgccatggacacgtctcaactgcgcaactgcttgcccatgtttccctgccccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgtttttttntttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaakaaaaaaaaaaaaaaaaaaaaaaaaaaaaaaaaaaaaaaaaaaaaaaaaaaaaaaaaaaaaaa

SEQ ID NO: 131 - DNA, 2041 bp, Homo sapiens
ggcacgagcgcgcggcagggccctggacccgcgcggctcccggggatggtgagcaaggcgctgctgcgcctcgtgtctgccgtcaaccgcaggaggatgaagctgctgctgggcatcgccttgctggcctacgtcgcctctgtttggggcaacttcgttaatatgaggtctatccaggaaaatggtgaactaaaaattgaaagcaagattgaagagatggttgaaccactaagagagaaaatcagagatttagaaaaaagctttacccagaaatacccaccagtaaagtttttatcagaaaaggatcggaaaagaattttgataacaggaggcgcagggttcgtgggctcccatctaactgacaaactcatgatggacggccacgaggtgaccgtggtggacaatttcttcacgggcaggaagagaaacgtggagcactggatcggacatgagaacttcgagttgattaaccacgacgtgtggagcccctctacatcgaggttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacggtatacggatccgggtctcagacaagggcgttccagtacgtcagcgatctagtgaatggcctcgtggctctcatgaacagcaacgtcagcagcccggtcaacctggggaacccagaagaacacacaatcctagaatttgctcagttaattaaaaaccttgttggtagcggaagtgaaattcagtttctctccgaagcccaggatgacccacagaaaagaaaaccagacatcaaaaaagcaaagctgatgctggggtgggagcccgtggtcccgctggaggaaggtttaaacaaagcaattcactacttccgtaaagaactcgagtaccaggcaaataatcagtacatccccaaaccaaagcctgccagaataaagaaaggacggactcgccacagctgaactcctcacttttaggacacaagactaccattgtacacttgatgggatgtatttttggcttttttttgttgtcgtttaaagaaagactttaacaggtgtcatgaagaacaaactggaatttcattctgaagcttgctttaatgaaatggatgtgcctaaaagctcccctcaaaaaactgcagattttgccttgcactttttgaatctctctttttatgtaaaatagcgtagatgcatctctgcgtattttcaagtttttttatcttgctgtgagagcatatgttgtgactgtcgttgacagttttatttactggtttctttgtgaagctgaaaaggaacattaagcgggacaaaaaatgccgattttatttataaaagtgggtacttaataaatgagtcgttatactatgcataaagaaaaatcctagcagtattgtcaggtggtggtgcgccggcattgattttagggcagataaaagaattctgtgtgagagctttatgtttctcttttaattcagagtttttccaaggtctacttttgagttgcaaacttgactttgaaatattcctgttggtcatgatcaaggatatttgaaatcactactgtgttttgctgcgtatctggggcgggggcaggttggggggcacaaagttaacatattcttggttaaccatggttaaatatgctattttaataaaatattgaaactcaccaaaaaaaaaaaaaaaaaaaa

SEQ ID NO: 132 - DNA, 2012 bp, Homo sapiens
  SITE (202): n equals a,t,g, or c
  SITE (541): n equals a,t,g, or c
  SITE (560): n equals a,t,g, or c
taccaagctgcaagaatctactatatcatggcagaagaagtagagtgggactattgccctgaccggagctgggaacgggaatggcacaaccagtctgagaaggacagttatggttacattttcctgagcaacaaggatgggctcctgggttccagatacaagaaagctgtattcagggaatacactgatggtacattcaggntccctcggccaaggactggaccagaagaacacttgggaatcttgggtccacttatcaaaggtgaagttggtgatatcctgactgtggtattcaagaataatgccagccgcccctactctgtgcatgctcatggagtgctagaatctactactgtctggccactggctgctgagcctggtgaggtggtcacttatcagtggaacatcccagagaggtctggccctgggccaatgactctgcttgtgtttcctggatctattattctgcagtggatcccatcaaggacatgtatagtggcctggtggggcccttggctatctgccaaaagggcatcctggnagccccatggaggacggantgacatggatcgggaatttgcattgttgttcttgatttttgatgaaaataagtcttggtatttggaggaaaatgtggcaacccatgggtcccaggatccaggcagtattaacctacaggatgaaactttcttggagagcaataaaatgcatgcaatcaatgggaaactctatgccaaccttaggggtcttaccatgtaccaaggagaacgagtggcctggtacatgctggccatgggccaagatgtggatctacacaccatccactttcatgcagagagcttcctctatcggaatggcgagaactaccgggcagatgtggtggatctgttcccagggacttttgaggttgtggagatggtggccagcaaccctgggacatggctgatgcactgccatgtgactgaccatgtccatgctggcatggagaccctcttcactgttttttctcgaacagaacacttaagccctctcaccgtcatcaccaaagagactgaaaaagcagtgccccccagagacattgaagaaggcaatgtgaagatgctgggcatgcagatccccataaagaatgttgagatgctggcctctgttttggttgccattagtgtcacccttctgctcgttgttctggctcttggtggagtggtttggtaccaacatcgacagagaaagctacgacgcaataggaggtccatcctggatgacagcttcaagcttctgtctttcaaacagtaacatctggagcctggagatatcctcaggaagcacatctgtagtgcactcccagcaggccatggactagtcactaaccccacactcaaaggggcatgggtggtggagaagcagaaggagcaatcaagcttatctggatatttctttctttatttattttacatggaaataatatgatttcactttttctttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttagacagcaaaccctatccattaaagtacttgttagaacactgaaaaa

SEQ ID NO: 133 - DNA, 1669 bp, Homo sapiens
gagcagtattttaaccaacttgtattacagatgttacagttcatgttaggaagtcagaaaagactttgtttgtctttgttctgctgatgtgagtcatgttttgtggggtcttccatggcacatttacctgttgctccgtccagatgttgagggccagtctaggctgacacatcctacccgaggacaagcctgttctccatttcttcactctcccctccccatatagcaactctcccaggtttagattaccgttttcgacgacagattaaccaaaaatgccccacacaggttttattactgttatatactatacttttaacagtacagaccctaaattttattatttgttgctcccccaatctgataccaaatgtttaaagttgtttgaaatccaaacatggtagtgttcatgggtaaatattttctaggctatgtaagagttagcagcccatagcatagaagtaatcaagtagcatctgagactgttggaggcactagggcctctctgggcctaacagcctcacttccccagcctcaccttgctgtcctctgacactgccatcagggctgttagtggcacctgtatgaggccaagtgtgcgtccaggggaacagcacaggttaatgcgtctccctagaactcatgaagtcagtttaattcatgcatgaacatgagttcattttatgttttatatagctttcttagacataccaaaccatcattcataaatcagataaattattcagtttttgtgtttagaaagctaagtatgtgtagctggaaacaaaaatgagcgtgttttctctcctgttaatctagagtgtgcagttacacatgtgtggataatttcatgttccaggggcgcttggcatctcccatggactgattcccaggaagaaaagcccaaagggaaacccacgattcctttcgagtagatgtgggaaagagcccattggaggatatgaggtcctgtgaaattcagttgtgtgtgtggctccttgttagcagtcatgttgacatggtgttaggaggctccccatccaccctttacatgatgtagggaccagtgtcttgtgagattaaccttgggacacagtgggttagcctggagaaaatgagaggccctgcctggacccagggagaggagccagtgacacaggcagagcggtgcagccctccttcccttccatttggaggaggtggtgccaggagcctgcccgcttacctctgctgaagcataagtggactttgcttttggggcttatctctgatacatgctggagccctgcctctccactgctagatggaacctggaatctctcatctacctcttagtctgtcagtttctacgtgtgagaagcaagcttgtgggccagtgtccttgtacatgctgtagcacttaaaaaataattccagggttccctggaaaaccagtcccagggttcctatgatctgtagtttctacctggattataactggttttgggtacctgaattttgattggttagccttaattatagtctggcgtgatcatgtagaatcttttctggtgaacagatcataaagttctatcaaggagttctatcaaggcatccatgtcagtggtgctatgctggttacaacttgagatttttgaaataaaaaatttgtcataaaaaaaaaaaaaaa

SEQ ID NO: 134 - DNA, 1565 bp, Homo sapiens
  SITE (58): n equals a,t,g, or c
  SITE (1075): n equals a,t,g, or c
cacttttgctatataacctaagtgataaccctcttttagttacctgccaaactctggncttggtttatattgcagttaacacagttacaaagctgtaatggtgtctttttttcctttgtaacggaatgtgtaaatcaaagtatatacattgtgtggtgttcctgtttctggagtttcatgaggatttacacatggcattcagtgttctgtatagatctgcctacctttgtgaattcatctgttaacccctcttcctttgagagagcaccggcgatggtggttaactccttgtgttttctctctctcctactggttattcttgaattaagcacagactcgtcagctcggttgctttatcatgaataatgtgtgtgaccttgcagttcttccacagttcagcaaacaagtgctagcttcactgaccaaaaattaaggaaggaaaacacagtttttaaaacgatccatcttttaacagccgaaaccgatgtgtctatggtgctgcaccttgctgttgtacttctgaaatcagacgtgtgtgaacgatcatttctgacttaaccgtgagatgctcacgagtacccttcctgttgttttgttagcattgaaatcgagactatttatttggaatatatacaacagtgtttttccactgtatttcatttgcaaaagttgagaactgctttctctaccttttgcaaaataattgatattccatattggattctcaaagacttcgatatggtgaacctattaaacctagaaattgtattcatcctttcatgactgtggcctgagttccccagcccctctcctccttttttttagatgagatttagcacactctcagttatttaaacatgcaacatttcttgagtatgtatgttgaggccatctgagctcatagctgattcagtaaccagtttcatgctgtgtcattcacactcactacttaatactgccatggtgaaaatgtggaggaaaaatgtatccatgtgtgtctgggaagcatatacacttgtacattttttaatactctgattctgtaacatttctgagttttgttttgttttacagnaaaaaaaaaaaaagtgataaagcaatcagaagaccaagaggtttactattgatgcttagggtcgtctgaccttggctggccaatagacctacacggccaaattaatttacgagagtaataatttttcaaaagccaattttttttctgtattttctgtatgaaactgccaatatcatgaatagaaagggagaaccataaaggagaaagaacgtgatgttctgttatgttcatgtaaacctaaagaaacagtgtggaggcaggcgcgatcagccgaactctagggacttggtgttgcttggaaggcatccatacctgcattttgcattcttcgtatgtaatcatattgccaaagacaaactatttcatcatttattgtaaataacacttttccccagacctaccataaagtttctgtgatgtattgtcttccagttgcaataaaaattactgagttgcatcaattgaagaaaaaaaaaaaaaaaaaactcga

SEQ ID NO: 135 - DNA, 2007 bp, Homo sapiens
tctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggcagttctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtkttgggggccaggtgtgtcacacaagcatctcaaagtcaaaagccatctggggctgctgcttctctttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgtcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttaaaaggaaacccagtcatcccactatgaatctggcatcttcttatgcttctagtgttttggccatacatcaaccaaggggtttaatttatccaatgcttgacgacatgttcaggaggggctggatcaaattttgagagggttatgggaaagggagggggagaagaaattgacatttattttattatttattttaaatgtttacatcttctttatgttgtatcaagcctgaatagaaactgatagcattaaaatactccgttcctctctctcttctcgcttcctttttttttttttttaaatttaggataacacatttttgtttctaaagtgatttgtgatttgtgctgtataaactgtataaaaggttctgtttttaaaggtggattttcattcctctggggacagtggtcgccaagacatctacattgtaagagaacacagtggaagatcctgtcctgattctcaaaaattattttctctgtatgattaaaagt

SEQ ID NO: 136 - DNA, 1291 bp, Homo sapiens
cttttaaccctcccccttcacacacatacatatcaggttgttttctagttaaaaacccaagtagctcagattctactttaatgtcagtgcagatttgcattgaatcatgccattatgttttttctcatttttatgctgttgggtcttagtttttaaattgatataaagaactcagcaatggttttattttctactcatacttagggtttaggaaacactaccactagttatcatttaatcaacttcaatggtctactgaaacaaaaatggtaacttttcattagtggattatttagagttatagtagttgtttccagaaaacacttcctcacaattgtacttcccaatcaaatcatgtgatcatacagttattcccatgaaaggcagaatgtttgtttcaaaattaatctagttttctgtacatttaaatttgagaaggtgacaactggctcttttccagtcttccttcatgtcagttttctgatagaccactattggcaaacagtatctgtcaactaccaaatgtgtaaaattttctgtatttcactttgtcttatttgtaaatagtgaactaaaacttttggcagatcagcaacatttgctgagcctgttttttaagctaatgtgtattcttactaatgttcctatcaagaatggatttgtaatatatgctgtctatttctaatgttcacattcatattttgaggttctatcttattttaatagagaacagacttctcaaaaaatcttcagaagcagcttattattgaaatatcgaaatattgaaataaacccggtgggttagattactcatctgtccaccaagtgggacatttgcatggactgggggcttaaaggacttagaagagacctgtaagtaaatcctgaaaatgagccaatccccacttgaatggttactggagtaaacccacctttaccaccccaattacagcacccgaggccgataaaccaacttggctctggttcatttttcttttcttcatttgtgatgctcagattcaaaatgtgtgttctacactgttacaggcttctcttttgtttgattaaagattttagtcctacttttgtatggacacattagaatattcagagaccaaaatagaagaatttgctgttagatatttttcagaagtcagcagatttgtggcaaatcatttatttgcctttttaaaaattcatttaagcagttcagagagtagactactcagaaaattatttcacgtaattgtctaagaggtcaatattttttaatgcatattgaatcaaataa

SEQ ID NO: 137 - DNA, 1906 bp, Homo sapiens
ggcacgaggacctacttttgtaacagaccatggttgtgtccaaggtaaaaccacagtgatatttttggatgctttgtctgcaatcttgacttgtttttgcagtatcattattcagacttcaaattgtgaatcttttaaacatcttgataatttgttgttgagagctgttcattctaaaatgtaatgaaattcagtctagttctgctgataaagatcatcagttttgaaaggttactgattttcctcttccctcttagttttttacccaatatatggagaagagtaatggtcaatcttaacattttgttttaattgtttaataaagctgctgggcagtggtgcagcattcctacctagtgtcataaaagcaaaatacttacatagctttcttaaaatataggaatgacattacatttttaggagaaagtaagttgctttgcaccgcctacttaattcctttccatatattgtgatacaaacttttgaatatggaatcttactatttgaatagaaatgtgtatgtataatatacatacatacataagcatatatgtgtgtgtgtgtgtgtatatatatatatatgcatgctgtgaaacttgactacacaacataaatcactttttaaattccaggaacgggtagtctgacacggtgattatccttttgaggctgaatccgttattaacttgttatttaggttttactcccagtagcaagggattctaagttagttgcacttacatgattattgtgatttaaaactaagaataaaggctgcattttcaaagataaattggaattgctgttggtgaaataacaaccaaaatactgaatctgatgtacatacaggtttctacaggaagagatggtataatttacaatttggagatttaataaccagggctacccagaaaaagtgacttgataacatggtaccaataagtaagggatgctctctcggtttgcttttgccactttcaagattttaacttctcaggttattaatcaaaattattgtataagttagccaatagaatttttaggttaaaacaacagatggggggtttgtggagtgtttaatgtcatgggcatttttagtagcatagaccctttgttctgcatttgaatgtttcgtatatttttgtttcacagttaatcttccctccccaagtttgctattcaaatcaactgcctgaatgacatttctagtagtctgatgtatttttctgaggaatagtttgtgattccaatgcaggtgtcttcattaccattacctctacactgcagaagaagcaaaactcctttattagaattactgcacatgtgtatggggaaaatagttctgaaaggctagaatgatacaagtgagcaaaagttggtcagcttggctatggagtggtggcaataatctctaaacattccaaaagaccatgagctgaacctaaactcccttgggaatctggaacaaaggaatatgaaaattgccatttgaaaactgaccagctaatctggacctcagagatagatcagccagtggcccaaagccatttcaagtacagaaattatagagactacagctaaataaatttgaacattaaatataattttaccactttttgtctttataagcatatttgtaaactcagaactgagcagaagtgactttactttctcaagtttgatactgagttgactgttcccttatccctcacccttccccttccctttcctaaggcaatagtgcacaacttaggttatttttgcttccgaatttgaatgaaaaacttaatgccatggatttttttcttttgcaagacacctgtttatcatcttgtttaaatgtaaatgtccccttatgcttttgaaataaatttccttttgtaaaaaaaaaaaaaaaaaaaaaaaa

SEQ ID NO: 138 - DNA, 1935 bp, Homo sapiens
  SITE (450): n equals a,t,g, or c
tctgaactaatgctaacagatccccctgagggattcttgatgggctgagcagctggctggagctagtactgactgacattcattgtgatgagggcagctttctggtacaggattctaagctctatgttttatatacattttcatctgtacttgcacctcactttacacaagaggaaactatgcaaagttagctggatcgctcaaggtcacttaggtaagttggcaagtccatgcttcccactcagctcctcaggtcagcaagtctacttctctgcctattttgtatactctctttaatatgtgcctagctttggaaagtctagaatgggtccctggtgcytttttactttgaagaaatcagtttctgcctctttttggaaaagaaaacaaagtgcaattgttttttactggaaagttacccaatagcatgaggtgaacaggacgtagttnaggccttcctgtaaacagaaaatcatatcaaaacactatcttcccatctgtttctcaatgcctgctacttcttgtagatatttcatttcaggagagcagcagttaaacccgtggattttgtagttaggaacctgggktcaaaccctcttccactaattggctatgtctctggacaagtttttttttttttttttttttaaaccctttctgaactttcactttctatgtctacctcaaagaattgttgtgaggcttgagataatgcatttgtaaagggtctgccagataggaagatgctagttatggatttacaaggttgttaaggctgtaagagtctaaaacctacagtgaatcacaatgcatttacccccactgacttggacataagtgaaaactagccagaagtctctttttcaaattacttacaggttattcaatataaaatttttgtaatggataatcttatttatctaaactaaagcttcctgtttatacacactcctgttattctgggataagataaatgaccacagtaccttaatttctaggtgggtgcctgtgatggttcattgtaggtaaggacattttctytttttcagcagctgtgtaggtccagagcctctgggagaggaggggggtagcatgcacccagcaggggactgaactgggaaactcaaggttctttttactgtggggtagtgagctgcctttctgtgatcggtttccctagggatgttgctgttcccctccttgctattcgcagctacatacaacgtggccaaccccagtaggctgatcctatatatgatcagtgctggtgctgactctcaatagccccacccaagctggctataggtttacagatacattaattaggcaacctaaaatattgatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtcgcacaataggccgtctgcaagctgggttagagagaagccagtagtggctcagcctgagttcaaaaacctcaaaactggggaagctgacagtgcagccagccttcagtctgtggccaaaggccaagagcccctggcaaccaacccactggtgcaagtcctagattccaaaggctgaagaacctggagtctgatgtccaagagcaggaagagtggaagaaagccagaagactcagcaaacaaggtagacagtgtctaccaccayagtggccataccaaagaggctaccgattccttcctgctacctggatccctgaagttgccctggtctctgcaccttctaaacctagttcttaagagctttccattacatgagctgtctcaaagccctccaatwaattctcagtgtaagyttcaaaaaaaaaaaaaaaaaaa

SEQ ID NO: 139 - DNA, 1446 bp, Homo sapiens
  SITE (1): n equals a,t,g, or c
ngcccccttggcacaagtcagatgaagcacgttctgccggggaggccctcamcttccagagaggacagacacagatttcctgctgggggagggaggagtccacgcatcctgatgctgcctggaagcttattttcccgtggccaggatgcatttctctgagtggaaacaggttcttgcatgtggatgtgtgtttccccaggcagacggcccctctyttcccagcacttccctgcctcccccaggcctcaggccagcacccagttcctcctcacatggcaggtgagcacagacttctagttggcaggagctgaggagggtgaacaaaccccgagggaggcccggcccttgctcccgagttggggggagggggtgtggcaacgtgccccccgcagaggccacgcatgtttgaccaaagccctcattgtggtccgaggacagccttttccccaggcctcaragcattgctcatccgtgccaaactgggtaggtggatttgagcggaaagactcccaaaatgtgccaagaatttcccrgtcccaggcagggcaggggaaactaagggcaagcaggatacagggcgagggatgtggcaggtgagggggctcccgcctgtgccccttctcctcaccatgtctcccccaccctgcctcagttctccgttccccttcatctccgtccccctctttgaagctgtccccatctcagtgtcagaccagccttctcctcakctgaccaccctcctctgaccsacgccccctccttgtctgaaaaaaggagccttgaatggtggagggaggcagtggggagaaaggtctcaccggacaggttgggagaatgaggtcagcggtgctggggaacagatggagggggcagtggggacagggcttgggcagacaccagcaggaataatttgaaatgtgtgaggtgactccccggaggccttgggcttgggcatttgggaaaagaatgatgtctggaagggcttaagggacacagtggacgaggggagagtcctcatctgctggcattttgtggggtgttagtgccaaacttgaataggggctggggtgctgtcttccactgacacccaaatccagaatccctggtcttgagtccccagaactttgcctcttgactgtcccttctcttcctacctccatccatggaaaattagttattttctgatcctttcccctgcctggtctagctcctctccaaacagccatgccctccaaatgctagagacctgggccctgaaccctgtagacagatgccctcagaattggggcatgggaggggggstgggggaccccatgattcagccacggactccaatgcccagctcctctccccaaaacaatcccgacaatcccttatccctaccccaaccctttgcggctctgtacacatttttaaacctggcaaaagatgaagagaatattgtaa

SEQ ID NO: 140 - DNA, 1109 bp, Homo sapiens
tttttttttttttgatatgaaattgtctttctccattgcagaaataagctagggaaacactaacccaaaaactttctgtagagctgttcctttggaggcagcatcacttattggcagtaaagactcagtataaaagcaccagcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgarggaggcattgttctttagttggagttctcatttttattctccagtactgacttgtggggaaagcatactttttcactgccaggtactgaatgcagaggctcagtgaagtatatatgtgggaagtgcatgcatttcgtttattagcaaacatagctggattaagacaaagttgttggtttggaaaggggttaaagccttaagtgaacaaatctagctaacagtgaatgaactaggtaatataacttgcatatttttaatttcctttggttaaaggtcccccatacttctctgttcggagacatgagaagtatgattacttcagtgttagttttcttaattttttttttcccctatttgtcccttgtcactttgttgcaagctagaaatctgtgggttatacatagggcagctctttgtgaaagtggtttattccactggagaaaggggattgaaaatcagttagaaccaatgtatttcttgccccacggaacactattcctataagatagctgaaagaagctgctgtgaggagctcagctccaaacacaggatcagcaccttgtataggaattcccatgaattatgacttctcattctgttttatcagagtgcatatatgtcctacttcaggaaaagtaaaacagtcatttacgaaagaaagtcaatctgtatcctaagcattttaataaaaagttaaaacaaaaaattaaaagggacactcgagggggggcccgaaacccaat

SEQ ID NO: 141 - DNA, 497 bp, Homo sapiens
taggactaacttaaattcttttattcatcttttatttattaaaaaattttatttctttgaattttcctgtaatttccttargctcttctataaaatgttatattcatgtgaaccatacctcattatccttaacatttactctcaaaaagctttttatttttatttttttgaaggtagtttttctgtgtgtactctgtaacatgattttgctttcaaatcattgttgtgcccccatacaaaatgccttttatttttgaggatcgtggactttttagtatggcatgagtgtgctaaaagccagatatctttccacattcactggtggctttgacacctagtttttaatctcccatccttactttaaaccctgacagtgcagtcctcagtcagggccaggaccgggctgaggccctttgtggagatgctgcaccaccagcagaaggctgagacctggttacctgtacctgttcacttgtaataaaaagaattatctaaaa

SEQ ID NO: 142 - DNA, 269 bp, Homo sapiens
atgaggcagaggcaagctgcctgccaaccccctccctcaaggaatggccttgcccaggaatgcccaccacacataccctcttctttttttctagtcaaactcttgtttattccttggcttgcctccctcctttcctcccctctcaaccttttacttctggtttctatttcatgggatttggggttgaagttaaacttacaacagtgccgccaacaccaagtcttgcaggaaaaaaatacaaagaaatttaacaaaaaaaaaaaaaaaaa

SEQ ID NO: 143 - DNA, 1269 bp, Homo sapiens
ttgattgactatggtctctccggctaccaggaagagtctgccgaagtgaaggccatggacttcatcacctccacagccatcctgcccctgctgttcggctgcctgggcgtcttcggcctcttccggctgctgcagtgggtgcgcgggaaggcctacctgcggaatgctgtggtggtgatcacaggcgccacctcagggctgggcaaagaatgtgcaaaagtcttctatgctgcgggtgctaaactggtgctctgtggccggaatggtggggccctagaagagctcatcagagaactcaccgcttctcatgccaccaaggtgcagacacacaagccttacttggtgaccttcgacctcacagactctggggccatagttgcagcagcagctgagatcctgcagtgctttggctatgtcgacatacttgtcaacaatgctgggatcagctaccgtggtaccatcatggacaccacagtggatgtggacaagagggtcatggagacaaactactttggcccagttgctctaacgaaagcactcctgccctccatgatcaagaggaggcaaggccacattgtcgccatcagcagcatccagggcaagatgagcattccttttcgatcagcatatgcagcctccaagcacgcaacccaggctttctttgactgtctgcgtgccgagatggaacagtatgaaattgaggtgaccgtcatcagccccggctacatccacaccaacctctctgtaaatgccatcaccgcggatggatctaggtatggagttatggacaccaccacagcccagggccgaagccctgtggaggtggcccaggatgttcttgctgctgtggggaagaagaagaaagatgtgatcctggctgacttactgccttccttggctgtttatcttcgaactctggctcctgggctcttcttcagcctcatgcctccagggccagaaaagagcggaaatccaagaactcctagtactctgaccagccagggccagggcagagaagcagcactcttaggcttgcttactctacaagggacagttgcatttgttgagactttaatggagatttgtctcacaagtgggaaagactgaagaaacacatctcgtgcagatctgctggcagaggacaatcaaaaacgacaacaagcttcttcccagggtgaggggaaacacttaaggaataaatatggagctggggtttaacactaaaaactagaaataaacatctcaaacagtaaaaaaaaaaaaaaaaac

SEQ ID NO: 144 - DNA, 1944 bp, Homo sapiens
aaaaggcaaactataggataacacagagccctttttgaaaataaattggcattggagtgttttaccctctagctgttttacttagaatgtaacatatgctgcctacccacctcaaaatgtctgtactgcaagagggccctgggcctctgctttccatattcacgtttggccagagttgtagtcccaaagaagagcatgggtggcagatggtagggaattgaactggcctgtgcaatgggcatggagcacaaggggtcacagcatgcctcctgccttaccgtggcagtacggagacagtccagaacatggtcttcttgccacggggtgttgttgtctctggtggtgctgcatgtctgtggctcacctttattcttgaaactgaggtttacctggatctggctactgaggctagagcccacagcagaatggggttgggcctgtggcccccaaactagggggtgtgggttcatcacagtgttgccttttgtctcctaaagatagggatctacttttgaagggaattgttcctcccaaataaatttgctttaccttggtcctttcttttgtgccagtattcaagtggtatagctctgagcagggtcacatttggccaaacctgacactgtcttgctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacatttcagctgcaagtcagcaatttcccaggtaccatgtaagctataaaacagtcattcttaaagacagaggatagctgtgactcatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgtagctcttggcctgtgtagagccccctcctgtgccctcagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattataaaaaaaaaaaaaaaaaaaaaaaag

SEQ ID NO: 145 - DNA, 1021 bp, Homo sapiens
  SITE (653): n equals a,t,g, or c
tcgacccacgcgtccggggtgcgcaacggggagttccggctggagacccgtgctctgggccggcgccttcaccatggcctcggcagagctggactacaccatcgagatcccggatcagccctgctggagccagaagaacagccccagcccaggtgggaaggaggcagaaactcggcagcctgtggtgattctyttgggctggggtggctgcaaggacaagaaccttgccaagtacagtgccatctaccacaaaaggggctgcatcgtaatccgatacacagccccgtggcacatggtcttcttctccgagtcactgggtatcccttcacttcgtgttttggcccagaagctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtaggggctctgcgggccctggcagccatcctggagcgccgggccgccatgctgcgcctgttgctgctggtggcctttgccctggtggtcgtcctgttccacgtcctgcttgctcccatcacagccntcttccacacccacttctatgacaggctacaggacgcgggctctcgctggcccgagctctacctctactcgagggctgacgaagtagtcctggccagagacatagaacgcatggtggaggcacgcctggcacgccgggtcctggcgcgttctgtggatttcgtgtcatctgcacacgtcagccacctccgtgactaccctacttactacacaagcctctgtgtcgacttcatgcgcaactgcgtccgctgctgaggccattgctccatctcacctctgctccagaaataaatgcctgacacctccccacaaaaaaaaaaaaaaaaaaactcgagggggggcccggtacccaattcgccctataaaggt

SEQ ID NO: 146 - DNA, 1285 bp, Homo sapiens
  SITE (1251): n equals a,t,g, or c
ggcacgaggagggccacggcagccatcgcgctttgcagttcggtctcctggtgtacggccaacgccaagtaggggattgcgttccctccagtcgcagaccctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatgtacttttctggaactagtttttaaattttagattatatgtccacctatcktaagtgtacagttaataattagcttattcaatgattgcatgatgccttacagttttcaataactttttttcttatgcaaacgtcatgcaataaaacaaactctaatgtttggcaaaaaaaaaaaaaaaaaantcgagggggggcccgtacccaattcgccctaaag

SEQ ID NO: 147 - DNA, 1386 bp, Homo sapiens
  SITE (821): n equals a,t,g, or c
  SITE (950): n equals a,t,g, or c
  SITE (955): n equals a,t,g, or c
  SITE (1023): n equals a,t,g, or c
ggcacgaggtggcgcaggggtcagtggttctctcgggtctcgggacaggtgagcaccctgatgaaggccacggtcctgatgcggcacctgggcgggtgcaggagatcgtgggcgccctccgcaagggcgscggagaccggttacaggtgatttctgattttracatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctgatacacacatacaacaagaacagctctgtgtgtgagaactstggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggancgctacatggactcctatgacatcgtgctggagaaggacgagactctggatgtggtcaacgggctactgcagcacatcctgtgccagggggtccagctggagatgcaaggcccctgaaggcgcaggctnccagnccgcctgcaggccgtggtgaggaggggcgcctccccagagtctgctcccccgtgaacacagagcagangccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaatttttaaaatgaaaaaaaagctgctctgattcaggggatgtgggtcggggtagaacctggacctcttggcctgggggcacatgggatgcttctaggaacacagtttgagaaccaccaaaaaaaaa

SEQ ID NO: 148 - DNA, 2098 bp, Homo sapiens
  SITE (2026): n equals a,t,g, or c
  SITE (2079): n equals a,t,g, or c
  SITE (2087): n equals a,t,g, or c
agcccttctccccgcgcttgggactctgacatcttaaggctgcacggtcgtgtccttgtctgggtgaggccatgtctgtgatccaaggttcctggaactgacacaggaaggggctgtgaaccctaagtgggtgtmatctcctccraccgaggcttctmaccctggagatggcagttactcctggccatggttgctgagcatgggcagaccagtggaggccaccctactgtgttatctgcgccttcratgaagtgagacccttggggagaacgggctgtggatgaaggagtggactgcagccttggcctagccactgggctgggatcttctgggtcatgtgactgtgtatccaggagcagaaacttgtattctcaggattcaggatctacccagcaccaaagatgtattttcaggagaacagacctagaaatgggcctgtctggcatttcagagtcaggcaaagcaggcagggccagggagcttctgtgggtctacacaagaaggttcctgtgagggctatcagttgttgccttctagcttgctggtaactttggcgcctccgccaagccctgccagactcccctggctgtgatggcattctgtgccatcctgccttgtccccagcctctgcaggatgccctccctacccamctytycctgggccttccctgtccactgggctggattcatgttcaaaccactggactggcagggcaacgacttcttcccacctcaagatgaggtcctcgcccccttgtcttggcataaaaacacctttaaagcatgagccatgtgcttctttgcccttctctgtcctgttccaatcttctgcctcccagtcactccctggggactatgggatcactgtccccccacctgtgtggccacaccatgtgtcctgtcaatccagaactgcctctgagctccaggctgaccacagatcagccacagcctgatgcctgcagccccactttgctcacccttcccctcccctcctccttccttccacacagcaagcctacctttytccatccatgctcaccatagcccccttccttgtgacctggaccctccattgtacctggctgagactgtcagcctcctggaggagtggggtccaccttcttcttgccctatgcagtgcaagcttcacttctcacccagcaaggttgactcatctgcctccatgtctctggggctttgctgttgccctgaaacctagctgggctggtcttgctcccagcttgcttccccctcctcggatgtccctttgcaggcccctgtcgttcctccggcaccagtgtccttggctgccatggcaagctcatcaggggcttgtaccctggtcaccaagcatggtagcagctgcctgcattgtatctccatctggtcactgcaggtgccaacccttcatcccccatgttttcctgggccatggagggctgacctccgtttctggggaatgtggctgagctgtggtaaccagctacaccccaggtgctctttccatggtggtgcctgctcatcttgctgatgcaaactaggaagttaggctgcatctcggagtggctttcgctggagaggtgctttgctgtctctcagactcagtcactgtgttccctccccgcctctcttatctccatggctgtttgcagctctcccaggtactttggggtctgagctggaattcctttgtggtttgctcttctgcttctcactcttgtattaagaaggattccacaaagggagagtggcatccctgctgctgctgtgccagaccagagtttcctgaggggccctgaccctaaccctccagctcagccctgtacacctgaccctgtaaatgagtggggtttgctgactgtaatccctgacaccagtaaaaccaaaaggactcttgggggctcagtgtgagagccagggttacctactctgccaagtgaggacaaactgctaggctgtatcccataatttcaggatgagaaacattaacaataaaaatttgtagtaaacataacctcatgangactaaaaaaaaaaaaaaactygggggggggcccgtaacccattgggcccttngggggggngttttaaaatt

SEQ ID NO: 149 - DNA, 1847 bp, Homo sapiens
  SITE (206): n equals a,t,g, or c
  SITE (323): n equals a,t,g, or c
tcgacccacgcgtccgaactgaggcggcggcgggagccggttggkgtctggtcttcgcgtcggccccgcggaccagacgctgcccccggcgcggggagaagatggtgcckagcggcctcgggcccgccacgcgccgccacgagtgagcccagcgcgaccgcgggcgtccgccgagcagctggcccggctgggcccggggcgcgcantgcccgccggggcggggtggagctgatcagaataatgttcagcatcaaccccctggagaacctgaaggtgtacatcagcagtcggcctcccctggtggtcttcatgatcagcgtaangcccatggccatagctttcctgaccctgggctacttcttcaaaatcaaggagattaaatccccagaaatggcagaggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaaccatcttagggcatcagattggactttcaggcagggaagcccacgaggagataaacatcaccttcaccctgcctacagcgtggagctcagatgactgcgccctccacggtcactgtgagcaggtggtattcacagcctgcatgaccctcacggccagccctggggtgttccccgtcactgtacagccaccgcactgtgttcctgacacgtacagcaacgccacgctctggtacaagatcttcacaactgccagagatgccaacacaaaatacgcccaagattacaatcctttctggtgttataagggggccattggaaaagtctatcatgctttaaatcccaagcttacagtgattgttccagatgatgaccgttcattaataaatttgcatctcatgcacaccagttacttcctctttgtgatggtgataacaatgttttgctatgctgttatcaagggcagacctagcaaattgcgtcagagcaatcctgaattttgtcccgagaaggtggctttggctgaagcctaattccacagctccttgttttttgagagagactgagagaaccataatccttgcctgctgaacccagcctgggcctggatgctctgtgaatacattatcttgcgatgttgggttattccagccaaagacatttcaagtgcctgtaactgatttgtacatatttataaaaatctattcagaaattggtccaataatgcacgtgctttgccctgggtacagccagagcccttcaaccccaccttggacttgaggacctacctgatgggacgtttccacgtgtctctagagaaggattcctggatctagctggtcacgacgatgttttcaccaaggtcacaggagcattgcgtcgctgatggggttgaagtttggtttggttcttgtttcagcccaatatgtagagaacatttgaaacagtctgcacctttgatacggtattgcatttccaaagccaccaatccattttgtggattttatgtgtctgtggcttaataatcatagtaacaacaataatacctttttctccattttgcttgcaggaaacataccttaagttttttttgttttgtttttgtttttttgttttttgttttcctttatgaagaaaaaataaaatagtcacattttaatactaccaaaaaatggacaaaaaaagtcgagggggg

SEQ ID NO: 150 - DNA, 1569 bp, Homo sapiens
gacgctgacgagagaaggcctcttccttgagggttggtgctgtgttgcagtgaccgtggcggattacgccaactcggatccggcggtcgtgaggtctggacgagtcaagaaagccgtagccaacgctgttcagcaggaagtaaaatctctttgtggcttggaagcctctcaggttcctgcagaggaagctctttctggggctggtgagccctgtgacatcatcgacagcagtgatgagatggatgcccaggaggaaagcatccatgagagaactgtctccagaaaaaagaaaagcaagagacacaaagaagaactggacggggctggaggagaagagtatcccatggatatttggctattgctggcctcctatatccgtcctgaggacattgtgaatttttccctgatttgtaagaatgcctggactgtcacttgcactgctgccttttggaccaggttgtaccgaagcactacacgctggatgcttccctgcctttgcgtctgcgaccagagtcaatggagaagctgcgctgtctccgggcttgtgtgatccgatctctgtaccatatgtatgagccatttgctgctcgaatctccaagaatccagccattccagaaagcacccccagcacattaaagaattccaaatgcttacttttctggtgcagaaagattgttgggaacagacaggaaccaatgtgggaattcaacttcaagttcaaaaaacagtcccctaggttaaagagcaagtgtacaggaggattgcagcctcccgttcagtacgaagatgttcataccaatccagaccaggactgctgcctactgcaggtcaccaccctcaatttcatctttattccgattgtcatgggaatgatatttactctgtttactatcaatgtgagcacggacatgcggcatcatcgagtgagactggtgttccaagattcccctgtccatggtggtcggaaactgcgcagtgaacagggtgtgcaagtcatcctggacccagtgcacagcgttcggctctttgactggtggcatcctcagtacccattctccctgagagcgtagttactgcttcccatcccttgggggcagcctcgagtgtagtccattagtaatcagattccagtttggacagggtggctggattgtatatctcgttagtaatgtacatgctcttcaggttctagggctcctgttaggggagggagaaatgttgaatcaagagggaaaacaactactatgatttataaacatattttaatgtaaaaatttgcatttaaaaggagtggccctgttttctgtgttaaaaccccatttggtgctattgagtttgttctttattcttttatcccagtgaaaattgttgatcttgctgtagggaaaaattaaactctttgaatctccaaacaaggaagtttcagcattcccttatggatcagaggaaccttagaggcctgaaattgttgcttccagtttagctgcccctcaaattcaagtgaatattttcccttctccctttacccttctccagaaataaagcaggtgacagggtttcagaatctt

SEQ ID NO: 151 - DNA, 1540 bp, Homo sapiens
cccacgcgtccggaaggattgaccagttaaccaacatcttagcccccatggctgttggccagattatgacatttggctccccagtcatcggctgtggctttatttcgggatggaacttggtatccatgtgcgtggagtacgtcctgctctggaaggtttaccagaaaaccccagctctagctgtgaaagctggtcttaaagaagaggaaactgaattgaaacagctgaatttacacaaagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtgggttccatcctcagtattttgatgggagcatcagctataactggaataatgggaactgtagcttttacttggctacgtcgaaaatgtggtttggttcggcaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactggattaatttcccttatgttgagggccatggraaaaaaattgggaaaaggaaaaactcagttttaaatacgggagactataatggataacactgrattcccctatttctcatgagtagatacaatcttacgtaaaagagtggttagtcacgtgaattcagttatcatttgacagattc

SEQ ID NO: 152 - DNA, 1719 bp, Homo sapiens
tacttatgaggtcaattggaaataagaacaccattttactgggtctaggatttcaaatattacagttggcatggtatggctttggttcagaaccttggatgatgtgggctgctggggcagtagcagccatgtctagcatcacctttcctgctgtcagtgcacttgtttcacgaactgctgatgctgatcaacagggtgtcgttcaaggaatgataacaggaattcgaggattatgcaatggtctgggaccggccctctatggattcattttctacatattccatgtggaacttaaagaactgccaataacaggaacagacttgggaacaaacacaagccctcagcaccactttgaacagaattccatcatccctggccctcccttcctatttggagcctgttcagtactgctggctctgcttgttgccttgtttattccggaacataccaatttaagcttaaggtccagcagttggagaaagcactgtggcagtcacagccatcctcataatacacaagcgccaggagaggccaaagaacctttactccaggacacaaatgtgtgacgactgaaatcaggaagatttttctatcagcacccaggtcttagttttcacctctagttctggatgtacattccatttccatccacagtgtactttaagattgtcttaagaaatgtatctgcatgaactccgtgggaactaaaggaagtgggaacttagaaccagacagttttccaaagatgttacaatttcttttgaaaaaccttttgtttattagcaccaatttctygccactaagctatttgttttattatacatcctttaattaaaaactatatatgtaacttcttagatattagcaaatgtctctgctaccatttccttaaggtgttgagctttaactctatgctgactcagtgagacacagtaggtagtatggttgtggacctatttgttttaacattgtaaaattttgagtcagattttaatattgtaaaatcttgggtcaaataattcaaagccttaatgcagatgcactaaaacaaagaaatggtaaatgaattgtttgcatttaaaaaaaaaaactcttaagaaaactgtactaaatctgaatcatgttttgagcttgtttgcagtacttttaaacattattcactactgtttttgaagtgagaaagtatcagccatttagcatttaagttggggtatttagagcctgtaatctaaatgctggctcaaatttattccccagctacttcttataccactattcttttaatgtttgcataatcataagcacctcaacacttgaatacataatctaaaaattatatagtaaagctggtagccttgaaaatgtcagtgtgatatctattatgtagataaatatatatagtggcctttcaggactgtcacagtaacactttatttacagagctaatgtttgtcctaaattttcaggaccctagaggagagctttatacaattaccgatgtgaatttctctaaagtgtatatttttgtgtccagttatattatttaaaaaagtgttactttgtaaaaattgtatataaagaactgtatagtttacactgttttcatcttgtgtgtggttattgcttaatgctttttaaacttggaacactcactatggttaaataaggtcttaaaagaaatgtaaatattytgttaataaagttaaatattttaatgat

SEQ ID NO: 153 - DNA, 863 bp, Homo sapiens
  SITE (817): n equals a,t,g, or c
  SITE (859): n equals a,t,g, or c
ggcacgagggaagccgggacgatgtccgcatgacaaccgacgttggagtttggaggtgcttgccttagagcaagggaaacagctctcattcaaaggaactagaagcctctccctcagtggtagggagacagccaggagcggttttctgggaactgtgggatgtgcccttgggggcccgagaaaacagaaggaagatgctccagaccagtaactacagcctggtgctctctctgcagttcctgctgctgtcctatgacctctttgtcaattccttctcagaactgctccaaaagactcctgtcatccagcttgtgctcttcatcatccaggatattgcagtcctcttcaacatcatcatcattttcctcatgttcttcaacaccttcgtcttccaggctggcctggtcaacctcctattccataagttcaaagggaccatcatcctgacagctgtgtactttgccctcagcatctcccttcatgtctgggtcatgaacttacgctggaaaaactccaacagcttcatatggacagatggacttcaaatgctgtttgtattccagagactagcagcagtgttgtactgctacttctataaacggacagccgtaagactaggcgatcctcacttctaccaggactctttgtggctgcgcaaggagttcatgcaagttcgaaggtgacctcttgtcacactgatggatacttttccttcctggatagraggccacatttgctgctttgcaggggagagttgggccctatgcatggggcaaaacaggtgggattttccaagggaagggttcagaattaggcntgttgtttcagccatttccaaggaaggggaagggtttccctnccct

SEQ ID NO: 154 - DNA, 1101 bp, Homo sapiens
  SITE (713): n equals a,t,g, or c
  SITE (1055): n equals a,t,g, or c
aacagcaaaaaagaatgatttcttctgaaattgtggaacatgaggattcaagtttttattttgttactaggtgctggaggaacatcccagttcacaaagcccccatctcttcctctggagccagagcctgcggtggaatcaagtccaactgaaacatcagaacaaataagagagaaataagaatagaatgaatgaccccaaaatarggttttcttgggcgaggatgtgctggattaggaaaggtgacatgacacaggcagagcagagtggcacccaccacagaatacagtgtgtgttattacgaggagccagcagttgagcctaaggtccttctacctacctggtattggcatttgaggtcggaaaccctctactgccccataagccaggaaaagtgaaaagagaacacagttcctttaagaactggcagcaaggcttgaggccttatgtatgtagctgagtcagcaaggtacatgatgctgtctgctttcaaaaggacttttctctcctagctgactgactccttccttagttcaaggaacagctgagacagacctctgctgagtagctctgtgatgacaaagccttggtttaactgaggtgatcctcaggttgtgaggtttattagtccccaaggcaaacacaaatattagattaataatccaactttaatagtatacatttaaaagaaaaaaaacaaaagccctggaagnttgaggccaagcctgctgagtattgcagctgcatttgcccaaagggaatccagaacaagtccctccctgtattttgttcttgagaggggtcagtctagaagctagatcctatcaggatgaggagcagcagcccagggcttgtctggatcagcaccaacgattttaaagaaaaaaggaagagtttcttagatgagtaattgttattgaagatagtcagtgataaccactgaccagatgctatcaatacactatgtgtcctttttagaataaagattacatatcatcattcctttggggaaaattgttattcaggtataaaaacaagagattataataaaaaantaaaagaaccctaaaaaaaaaaaacctcgtgccgaattccctgcag

SEQ ID NO: 155 - DNA, 2031 bp, Homo sapiens
  SITE (41): n equals a,t,g, or c
  SITE (1855): n equals a,t,g, or c
  SITE (2016): n equals a,t,g, or c
caattaacccgtttgaggcctaggttgtttggcaagccccnggcctaaagttttaattcggcagagccaagggcctgaaaggaagggaaaggggagggtagcgggagggtagcaggtgagttcctagggctggaaggtttagcagcagcctggtgcagtgccctgtcatcaagacaaacccacggtcctcctgggtgcctaccaagcttggtttgtacaaaagcaaggtgggagtctatttttgtacatgagatacatcacacttacctgtgggccagtattgtgaagtgagtctgagttgtttacactgatgccttccctgcccaccacaaattgtgtacatagtcttcagaatgataccacccctttccccagctcccaaccaagagctggttctaggcctgtgttatatgtcatatttagcgtttttatatatgacctttgatttctgttgtttgtattttagcacagtgtatgcaccttcatttaaatacatctgtgtgcatacagatacgcatatatgtgtgtgcgtatgcatatatctctcatctgtagtttccaagagttcagctgaagcagatggagtcctgcagcccaggagacaccctgcatccctgctaatagtgtttgccacaagtattagtgagtcttccttattaatattttcatttcagaagactgaagcaaagctgatagtgtttgctgtttctttggcagctaagtgagggtcttgggatgacttgctgtgttcctcaagctgcactttggggccatctctgcagtattaagccccctttttgcttggtggtactctgtctgtgcctgtgtgtgtgtgtgatagtcactcttgcatggcttccatgtctggtttgtggcatttggggataagtgctgaaccagagcatttgcagtttgtttgaggcctcgttgccaatgatagatcactcctgttgacctggtatgtctgcttgcttgctgcttttccttgctttctcttggaagaggaaaggactctggtcaggcccaggctgagtgagatgagctgcagctggctcatggccttcttagagcagagagaggagtatgtcattttactaagttcctaaacaaacatttatgcaggcaacactccttgcagatccagaaactgaggcacaatagggttatgacttgctcaagaatatgtagctgctagggggtaaatcaaggcatcacaatttctgttcagcgggcaggaataggctgtgaattgctagcactttttttttaagcaattactttttgacttgttcctctgaaagtgcaagaggcgtacacctttcccaaatgtagactagaatctgcaggatgccacccactgtatagttctgctttcccagagaggaagaacttttagaaaccaaatgatcttaattgttattgcccacccctggcttttccgggtagaaaattcacagtaggaatgattgttaagagagagtgcttggaaccatgggttaacaggaaaggctacctaacttcacatatctgcaaccagagcagccaccaagcattacttagcagcaggaaaatgattgtatttgagttcctgtgtgtccaaaactgaggcaccatgttctttgaaaacatgccacctcaaggctgggcgcggtggctcacacctgttaatcccagcactttgggaggccgaggcgggcggatcaccggagtcggggagtttgagaccagcctggaccaacatgggagaaaccccatctctacctaaaaatacaaaattagccgggcgtggtggcatgcgcctataatctcagctacttgggagggytgaggcaggrgaattgcttgaacccrgganggcggaggtttgcggttgagttgaggatcgtgccattgcacttccgggccttggggcaacaacagcaaaaaytccgtcttcaamwmrtgccgaattcgatatcaagcttatcgataccgtcgacctcgagggggggcccggtacccaattcgccctatagngatcgtattacaatc

SEQ ID NO: 156 - DNA, 1981 bp, Homo sapiens
  SITE (475): n equals a,t,g, or c
  SITE (484): n equals a,t,g, or c
cctgcaccctgagcccttcacccctccgagttccccccaggttggcttccttcgattccttttcttggtatcaacgtttgattggaagaacaaccccctctttgtcaacctcaataatgagctcactgtggaggagcagctcgggcacagctcmccgtyatggtcattgttaccccccaagaccgcaaaaactctgtgtggacacaggatggaccctcagcccagatcctgcagcagcttgtggtcctggcagctgaagccctgcccatgttagagaagcagctcatggatccccggggacctggggacatcaggacagtgttccggccgcccttggacatttacgacgtgctgattcgcctgtytcctcgccatatcccgcggcaccgcaggcttgtggactcgccagytgcctccttctgccggggcctgctcagccagccggggccctcatccctgatgcccgtgctgggtnatgatcctnctcagctctatctgacgcagctcagggaggcctttggggatctggcccttttcttctatgaccagcatggtggagaggtgattggtgtcctctggaagcccaccagcttccagccgcagcccttcaaggcctccagcacaaaggggcgcatggtgatgtctcgaggtggggagctagtaatggtgcccaatgttgaagcaatcctggaggactttgctgtgctgggtgaaggcctggtgcagactgtggaggcccgaagtgagaggtggactgtgtgatcccagctctggagcaagctgtagacggacagcaggacattggacctctagagcaagatgtcagtaggatgacctccaccctccttggacatgaatcctccatggagggcctgctggctgaacatgctgaatcatctccaacaaaacccagccccaactttctctctgatgctccagcattggggcaggggcatggtggcccatgtagtctcctgggcctcaccatcccagaagaggagtgggagccagctcagagaaggaactgaacccaggagatccatccacctattagccctgggcctggacctccctgcgatttcccactcctttcttagtcttcttccagaaacagagaaggggatgtgtgcctgggagaggctctgtctccttcctgctgccaggacctgtgcctagacttagcatgcccttcactgcagtgtcaggcctttagatgggacccagcgaaaatgtggcccttctgagtcacatcaccgacactgagcagtggaaaggggctatatgtgtatgaatagaccacattgaaggagcacaatgccctcctgtgttgatgccacttcccagggtggagacagtggaaaagaaccgaggacaggaaaggattgggtaggtgaaggggtcaggggactggtagtcacccaatcttggagaggtgcaaaaagcactgggggctacccgttagctgcatctgccctggctgtttgcccgttcatgtcacaaactgccactactatgtacctgcagtggggttgcagagatgggggagactcaagtcttactccccaggagctcccagggcccaaggaggagaatgctgcctcctttcagtctggtctacacccactttctggtagcctctctgcttcctgtaattctggctgtttttccagactcagctcaaatagtgcccctccttaagcccatccctcgcccccagcctgaggtgatctttccctcctctgaactattagagcagttactgtctgttcagttcgtttggcaggcacacacagtggcataaattctattgttttgaactctgatttaaaattaaattgcagctgggcgtggtggctcatgcttgtaatcccaacacttagggagtmaggrgaatcacttgascycaggagtyctagaccaatctgggcaamagagagaccccatctcttttaaataaaaagttaaattgcttaaaaaaaaa

SEQ ID NO: 157 - DNA, 915 bp, Homo sapiens
gaattcggcacgagcgcggccatggcgctcctgctttcggtgctgcgtgtactgctgggcggcttcttcgcgctcgtggggttggccaagctctcggaggagatctcggctccagtttcggagcggatgaatgccctgttcgtgcagtttgctgaggtgttcccgctgaaggtatttggctaccagccagatcccctgaactaccaaatagctgtgggctttctggaactgctggctgggttgctgctggtcatgggcccaccgatgctgcaagagatcagtaacttgttcttgattctgctcatgatgggggctatcttcaccttggcagctctgaaagagtcactaagcacctgtatcccagccattgtctgcctggggttcctgctgctgctgaatgtcggccagctcttagcccagactaagaaggtggtcagacccactaggaagaagactctaagtacattcaaggaatcctggaagtagagcatctctgtctctttatgccatgcagctgtcacagcaggaacatggtagaacacagagtctatcatcttgttaccagtataatatccagggtcagccagtgttgaaagagacattttgtctacctggcactgctttctctttttagctttactactcttttgtgaggagtacatgttatgcatattaacattcctcatgtcatatgaaaatacaaaataagcagaaaagaaatttaaatcaaccaaaattctgatgccccaaataaccacttttaatgccttggtgtaagtatacctctgaacttttttctgtgcctttaaacagatatatattttttttwaatgaaaataaaaccatatatcctattttatttcctccttttaaaaccttataaactataamaaaaaaaaaaaaaaaaaaactcga

SEQ ID NO: 158 - DNA, 2117 bp, Homo sapiens
  SITE (2072): n equals a,t,g, or c
  SITE (2113): n equals a,t,g, or c
agagcgaagcgagggtggcgcgggtccgggcatgaagctgggccgggccgtgctgggcctgctgctgctggcgccgtccgtggtgcaggcggtggagcccatcagcctgggactggccctggccggcgtcctcaccggctacatctacccgcgtctctactgcctcttcgccgagtgctgcgggcagaagcggagccttagccgggaggcactgcagaaggatctggacgacaacctctttggacagcatcttgcaaagaaaatcatcttaaatgccgtgtttggtttcataaacaacccaaagcccaagaaacctctcacgctctccctgcacgggtggacaggcaccggcaaaaatttcgtcagcaagatcatcgcagagaatatttacgagggtggtctgaacagtgactatgtccacctgtttgtggccacattgcactttccacatgcttcaaacatcaccttgtacaaggatcagttacagttgtggattcgaggcaacgtgagtgcctgtgcgaggtccatcttcatatttgatgaaatggataagatgcatgcaggcctcatagatgccatcaagcctttcctcgactattatgacctggtggatggggtctcctaccagaaagccatgttcatatttctcagcaatgctggagcagaaaggatcacagatgtggctttggatttctggaggagtggaaagcagagggaagacatcaagctcaaagacattgaacacgcgttgtctgtgtcggttttcaataacaagaacagtggcttctggcacagcagcttaattgaccggaacctcattgattattttgttcccttcctccccctggaatacaaacacctaaaaatgtgtatccgagtggaaatgcagtcccgaggctatgaaattgatgaagacattgtaagcagagtggctgaggagatgacatttttccccaaagaggagagagttttctcagataaaggctgcaaaacggtgttcaccaagttagattattactacgatgattgacagtcatgattggcagccggagtcactgcctggagttggaaaagaaacaacactcagtccttccacacttccacccccagctcctttccctggaagaggaatccagtgaatgttcctgtttgatgtgacaggaattctccctggcattgtttccaccccctggtgcctgcaggccacccagggaccacgggcgaggacgtgaagcctcccgaacacgcacagaaggaaggagccagctcccagcccactcatcgcagggctcatgattttttacaaattatgttttaattccaagtgtttctgtttcaaggaaggatgaataagttttattgaaaatgtggtaactttatttaaaatgatttttaacattatgagagactgctcagattctaagttgttggccttgtgtgtgtgtttttttttaagttctcatcattattacatagactgtgatgtatctttactggaaatgagcccaagcacacatgcatggcatttgttccacaggagggcatccctggggatgtggctggagcatgagccagctctgtcccaggatggtcccagcggatgctgccaggggcaktgaagtgtttaggtgaaggacaagtaggtaagaggacgccttcaggcaccacagataagcctgaaacagcctctccaagggttttcaccttagcaacaatgggagctgtgggagtgattttggccacactgtcaacatttgttagaaccagtcttttgaaagaaaagtatttccaacttgtcacttgccagtcactccgttttgcaaaaggtggcccttcactgtccattccaaatagcccacacgtgctctctgctggattctaaattatgtgaattttgccatattaaatcttcctcatttatactattatttgttacgttcaatcagaatccccgaaacctcctataaagcttagctgccccttctgaggatgctgagaacggtgtctttctttataaatgcaaatggctaccgttttacaataaaattttgcatgtgcaaaaaaaaaaaaanaaaaaaaaaaaatcccgggggggggccggtaaccaatttgncccc

SEQ ID NO: 159 - DNA, 2395 bp, Homo sapiens
tttcacctattttatttaggttttctttttctttttttctttttttttcaaattccaaccagaagctaaatacaattggaaactggtaagcactagttttactccaaaggagtaggatcattcagatttactccaataaaagtatgcaacccttaagcaaagcttttcttcatttaaaaggagaaaaaaaaaaaacctatacagtagtctttccttatgttcattgcacaaaatgagttctgcttttagaactttgacactcaatggttaattttacaatttaagattccaactttataaccttttttctactccaaaacacccttgtaaagtttttctttaggatggtgtaaaaaccagcatttctgcacaattcactggaatttttttctttgtaataaaaatctcttctctgtaaaaccaaaaacaaaacaaaacaaaacaaaacaaaaccaaaagaaaagtcctctacctatcatggtttctgcagctatgcatgtatttctgttttatagctgctttatagctacttcagactccagatctgctttaatgtgtataactgcatccacacgcagcagaatactcttacaatagcaacttggggaaagagatctggaaaaaaaaaatacatgagtaccaggaaacaaacatggcccagtaaaatatgaggcaaaaatgcctacaatgagatgcgtttttcatttaagatttctttcccatggttgtattttctttttttaaaccagttctggtcattagaatgtatctgacagtgctctggaacaactgtgattatagcaaagttattgtttttaaaaatgttatttatacctgttacattcacttctcaccctctaaatactgatgacagatgtcaaagaggcaaaaaccagcacaaatgggaagaccataaaaatgagtatcaccttgtgctttcagatacatttaagcatttcagtgtacaatagtcctttcatttcacatttttagtaagatactgatgcagtgcagcaaatatgcaaagcatcttctttcacacagtccgtgcacgacatctaatttttgtttaagttctgagataaaaatgatttaaaaaaatccaggatgaacaagtttcaaaatgcatagtgttctgtgcatgagtccattttctttaaactctgaaagaataaagtggtaagaaaacaagaaaaaaaactgctgctgcattctctgatcttctccattttgctggtcagtactctactctggcatataaggacggaggtgaycctctatggtgccaactgccccagtgggtgagctgttcctgtggcaggtagaggcagatgctgcataacttgaagattgtagctttgttttttggagtctgcaagtgctgtctgtcaatgaagagaaacactgactggttaggattgttgacaacgattccagtcttgtccttgcggctcagtacatgcagaaactgtttttcatagtcaccatgatgaaactcaaatttgcctgaacaggcctaaaaggctcatcagattctttccacctagaaaacaggagacagacgattttttcaatatcattccgaggccaaagaatgaaatccatctcctgagtacagccaattacatcccttctcatagactgatatcgaggagcatggagctgtaccacatccttctgtaaaagctctagggaactttccaaggaatagctggaatctcgcacacctttcaggatattttcttcataattatttgtcatgactggtataacctcagacacttcaaaaagtgctgactttttcttcttctccttgaatacaaaggcaatatacatcttgaagtcaaactggtcagctagagattcttttttctttctaagctgagcacgtagtctgttcagagcttgtttcttccgggagtttgggtcccccattttgaaatacaggtggtactaaagcctttggaaattgtccactaaactatgggccactttttcttaagactcaagtacaacagaaacaagtcmttttttttcctgctaatatgattgattagcgaaaatcacgactataacccaaaaactgcaccttctgtcaatattagcagactgtcatattacagggtcaagaaacaaaagctgctgtccagtcatgtttggacaataacgtttggggtcagacgggaaaaagggaggaaagaaaggaaagaaagaggagaaaataactaactttctggaaaacacatttggcttaactgccaaaataaaggctttgcggagaaatgaaaagcctataatcaggatttaggtgtgcaataaaacacagctgacaccagaccaatccctaaaatccatccggattttcccccctttttagaaaagggattaaggaaca

SEQ ID NO: 160 - DNA, 2120 bp, Homo sapiens
  SITE (975): n equals a,t,g, or c
  SITE (1405): n equals a,t,g, or c
  SITE (2120): n equals a,t,g, or c
ccccggataccgcctgacgtagtgccaatcacacctctcgcgtctcggcgcctcggaggctaatgaggacgcctggcgaaacgcagtaacggatttccgggtggaccttcgctttacggctcgtgagttcttccgcccaacccagaggaagcgggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggcattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggasatncaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcagtggnaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtcttaaaaaaaaaaaaaaaaaaaaaaaaaan

SEQ ID NO: 161 - DNA, 900 bp, Homo sapiens
  SITE (495): n equals a,t,g, or c
ggaagctgaagtccttccagaccagggacaaccagggcattctctatgaagctgcacccacctccaccctcacctgtractcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtgcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgcnttccgctattgcccaagtggcaaacacgtggcctacgtggaaggcagcaggagccctcacgagggggaccttgagttcattagcatggacctgcacaagggatgcgggccctcccgccgcrgcgacctccagagcctgggctactgcatgctgaagtggctctacgggtttctgccatggacaaattgccttcccaamamtgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatat

SEQ ID NO: 162 - DNA, 1003 bp, Homo sapiens
ggcacgagatgaggggcacccagtgcttctagggcaggctgggtggtggtcccctaggtatcagcctctcttactgtactctccgggaatgttaacctttctattttcagcctgtgccacctgtctaggcaagctggcttccccattggcccctgtgggtccacagcagcgtggctgccccccagggccaccgcttctttcttgatcctctttccttaacagtgacttgggcttgagtctggcaaggaaccttgcttttagcttcaccaccaaggagagaggttgacatgacctccccgccccctcaccaaggctgggaacagaggggatgtggtgagagccaggttcctctggccctctccagggtgttttccactagtcactactgtcttctccttgtagctaatcaatcaatattcttcccttgcctgtgggcagtggagaggctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaaacctgggaatggctggaggtgggagagaacctgaacttctctttccctctccctcctccaacattactggaactctatcctgttaggatcttctgagcttgtttccctgctgggtgggacagaggacaaaggagaagggagggtctagaagaggcagcccttctttgtcctctggggtaaatgagcttgacctagagtaaatggagagaccaaaagcctctgatttttaatttccataaaatgttagaagtatatatatacatatatatatttctttaaatttttgagtctttgatatgtctaaaaatccattccctctgccctgaagcctgagtgagacacatgaagaaaactgtgtttcatttaaagatgttaattaaatgattgaaacttgaaaaaaaaaaaaaaaaaa

SEQ ID NO: 163 - DNA, 2196 bp, Homo sapiens
  SITE (1837): n equals a,t,g, or c
  SITE (1840): n equals a,t,g, or c
aagaagcggcacacggatgtgcagttctacacagaagtgggagagataaccacggacttggggaaacatcagcatatgcatgaccgagatgacctctatgctgagcagatggaacgagaaatgaggcacaaactgaaaacagcctttaaaaatttcattgagaaagtagaggctctaactaaggaggaactggaatttgaagtgccttttagggacttgggatttaacggagctccctataggagtacctgcctccttcagcccactagtagtgcgctggtaaatgctacggaatggccaccttttgtggtgacattggatgaggtagagctgatccactttragcgggtccagtttcacctgaagaactttgatatggtaatcgtctacaaggactacagcaagaaagtgaccatgatcaacgccattcctgtagcctctcttgaccccatcaaggaatggttgaattcctgcgacctgaaatacacagaaggagtacagtccctcaactggactaaaatcatgaagaccattgttgatgaccctgagggcttcttcgaacaaggtggctggtctttcctggagcctgagggtgaggggagtgatgctgaagaaggggattcagagtctgaaattgaagatgagacttttaatccttcagaagatgactatgaagaggaagaggaggacagtgatgaagattattcatcagaagcagaagagtcagactattctaaggagtcattgggtagtgaagaagagagtggaaaggattgggatgaactggaggaagaagcccgaaaagcggaccgagaaagtcgttacgaggaagaagaagaacaaagtcgaagtatgagccggaagaggaaggcatctgtgcacagttcgggccgtggctctaaccgtggttccagacacagctctgcaccccccaagaaaaagaggaagtaacttctgaactttggccctgagctccattcttcctccagccaacccctgaaaattttacatgacatagaaactgtatttttcctttcgttttcatttgaagttttgccatttgtgtttatgggtttagggggccatttgtgtggaccaatctactcggggaattccaggcccaccaggacacgtgccaatggccccattcagatggcaagggaggaggtgttcttgaagacaggaggaggctcccgctgttaataaatattgtttcattcttctctcttcctgtcaccttctgccaagacattgatggcttctgacatcttatttggtgtctcaaagctgtatttccaagacagtggtacaaggtgacccttaattacccgtatcatggttcttgaccagcacattcaatcctccaacctaccctactgccatgaccttccgcacatctctaagttttatctttgcaatactcaaggttctcggaaatttgctaatggttgtgataaaccatacagcttgagccagtgaggcagattgggctggtgccttcgtctgagttttcctgctttcctgcctcgtgcagattctgaggtatatctgctgccttggaagacataagaagcagtgatactccctggctcggttattttctccatacaatgcacacatggtacaatgatagaaggcaaaattgccactgtcttcttttttttctcatatatctaaggaagatatatcaggttgtgcctcatgtaccgcttctagtgaaatgtagaggaaggctcaaaggagtcaacatttagatctggaagggacaagtcatgccttgggcctagaataccctgatgagaaaagagaagaggaagggaggccatatctacaacancancctctcggcactgctgctccttattttaactttgtcttgcattgtcctgtatttatcacagtttctgttgaacagcttttcaagtatttggggagtttatcttgccatcctccccttctggttctctgcacccacctgtcccactgcagttccttccgtgctctgtgactttaagagaagaaggggggaggggtcccggattttatgtttgtttgttttttctccttagcagtaggacttgatattttcaattttggaagaactaaaagatgaataaactgggttttttttgttgtttgtttttgtaaaaaaaaaaaaaaaaaaaaaaaaaaaaaaaaaaaaaaaaaaaaaaaaaa

SEQ ID NO: 164 - DNA, 1945 bp, Homo sapiens
gcacagagtcgggcggacggacagggagaggaggagagggggtctgcgcgcggccgctacccagaagccagcggacggcagcacggagtgggctgtccccgagcccagccccgagcgagccccccccccgcccccgmaggacgcgcctyccagccagcccgactyctaggaggaggggaggcgggaaagcagctcaagcctcacccaccgccctgcccccagccccgccactcccaggctcctcgggactcggcgggtcctcctgggagtctcggaggggaccggctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcrgtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttcctagtgaaaaaaaaaaaaaaaaaaaaaaaaaaaaaaaaactcga

SEQ ID NO: 165 - DNA, 2933 bp, Homo sapiens
gggtcgacccacgcgtccggcagccgtcgtttgagtcgttgctgccgctgccccctcccggatcaggagccagtgtataccgcccgcccaccgccttggtgccgctagaggaaacgagaaggaggccgcctgcggtttgtcgccgcagctcgcccmcygycyggragagccgagccccggcccagtcggtcgcytgccaccsctcgtagccgttacccgcgggccgccacagccgccggccgggagaggcgcgcgccatggcytctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacagtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaaaaaaaaaaaaaaaaaaaaatccgggggggggcccgaaccattt

SEQ ID NO: 166 - DNA, 2243 bp, Homo sapiens
  SITE (19): n equals a,t,g, or c
  SITE (57): n equals a,t,g, or c
tcggagagccggcgggcgngcgcctctcggccaggaagcgcctcttggacgcgtgtnaccgatgcccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacargaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggratttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaacc

SEQ ID NO: 167 - DNA, 1816 bp, Homo sapiens
  SITE (7): n equals a,t,g, or c
  SITE (14): n equals a,t,g, or c
  SITE (37): n equals a,t,g, or c
  SITE (914): n equals a,t,g, or c
  SITE (1808): n equals a,t,g, or c
ggtgggnagctttnaatttccccttacwggggcgctntaaggggaaaccttcccggaattttcgggtcgacccacgcgtccggccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaagagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggktgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccrgtctaagcccagraatcccaggtacgcaccacatttggagccaggagccctaccaaatttgrgrgrawcmtctctaagcaaaatgtccntcakmtcgsmaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaacttgttgctacacgctgttggacgcagtatagtttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaaaaaaaaaaaaaaaaaaaaaaaaaactcgagggggggcccgttaccaaktcgccctatwgtgadtbgtattmttattttactaatatctgtagctattttgtttttkgcttkggttatkgtttttytcccttytctwagctatragctgatcatkgcyscttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataattatgtgctgaaaaaaaaaaaaaaaaaaamwmraraskrrwwactcgagggggggcccggtacccnattcgccg

SEQ ID NO: 168 - DNA, 945 bp, Homo sapiens
agaaaccgttgatgggactgagaaaccagagttaaaacctctttggagcttctgaggactcagctggaaccaacgggcacagttggcaacaccatcaacttctcccaagcagagaaacccgaacccaccaaccaggggcaggatagcctgaagaaacatctacacgcagaaatcaaagttattgggactatccagatcttgtgtggcatgatggtattgagcttggggatcattttggcatctgcttccttctctccaaattttacccaagtgacttctacactgttgaactctgcttacccattcataggaccctttttttttatcatctctggctctctatcaatcgccacagagaaaaggttraccaagcttttggtgcatagcagcctggttggaagcattctgagtgctctgtctgccctggtgggtttcattatcctgtctgtcaaacaggccaccttaaatcctgcctcactgcagtgtgagttggacaaaaataatataccaacaagaagttatgtttcttacttttatcatgattcactttataccacggactgctatacagccaaagccagtctggctggawctctctctctgatgctgatttgcactctgctggaattctgcctagctgtgctcactgctgtgctgcggtggaaacaggcttactctgacttccctgggagtgtacttttcctgcctcacagttacattggtaattctggcatgtcctcaaaaatgactcatgactgtggatatgaagaactattgacttcttaagaaaaaagggagaaatattaatcagaaagttgattcttatgataatatggaaaagttaaccattatagaaaagcaaagcttgagtttcctaaatgtaagcttttaaagtaatgaacattaaaaaaaaccattatttcactgtcatttaaagataatgtg

SEQ ID NO: 169 - DNA, 902 bp, Homo sapiens
  SITE (870): n equals a,t,g, or c
  SITE (874): n equals a,t,g, or c
  SITE (878): n equals a,t,g, or c
ggcagagccacaggaaggatgaggaagaccaggctctgggggctgctgtggatgctctttgtctcagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtggaagattctggactgtatcagtgtgtgatctaccagcctcccaaggagcctcacatgctgttcgatcgcatccgcttggtggtgaccaagggtttttcagggacccctggctccaatgagaattctacccagaatgtgtataagattcctcctaccaccactaaggccttgtgcccactctataccagccccagaactgtgacccaagctccacccaagtcaactgccgatgtctccactcctgactctgaaatcaaccttacaaatgtgacagatatcatcagggttccggtgttcaacattgtcattctcctggctggtggattcctgagtaagagcctggtcttctctgtcctgtttgctgtcacgctgaggtcatttgtaccctaggcccacgaacccacgagaatgtcctctgacttccagccacatccatctggcagttgtgccaagggaggagggaggaggtaaaaggcagggagttaataacatgaattaaatctgtaatcaccrgctaaaaaaaaaaaaaaaaaaacncgancctnggttttcagctccatcagctcctt

SEQ ID NO: 170 - DNA, 1883 bp, Homo sapiens
agaaaacaactgaaaaaccacatttttctacatacagctggggaggtagctgagaacttggcactgcgcacacatactaggttgaaagagagttgaggaaaccagaaggccaagtggatctgctggcaaaccctgaacctgtctcctgcgcttgctctacagttctgaagttgaaaatccttttcatgcctagcatctgcttgagttataaaccccaaggcagccatgtcatagactagtgtttactcttgttttgactttgttttaatgcttcctaagacccaagtgcctcctgctgtttcctcctttgtggtagcctctggccatctgggacctcaatccccagctttcccactttcagcagtcctttgctctctttgcttctacctcaaatagccccaggagtgggctttagtctccaatatggagcatytcaagcttctcctgggggatggggattgggatgggcagaatctgttttggwtctccgggttatttccagtgggtgtaaaagcagagctgggcctttccctctcttatccctgagggtgggtaagaaggactgtatctacacctgttcttccctaccttctcttttgttagggaggcctcattctaagttcctcaagagagtccttggcttaaagctgtagcaagggtgtgctaggtgggggatttggagcaaaaccgtcgagtaggcatgatactggtatggagtgggcctgcaaaatcagacagaaatggcttgagaagccgcaggggagcatgcctgtctctcagtgatagagtatgggagggacctccctagcttggaaaatgagaattgaaggggttatgaacaaataggatgcctagttgaggatgttcccaaagttttgtccaatcttatcattagtagattttataagccacagagacaaaccagaaacggaataatgttactttggatgctttatttttttgttctaggtgtggctttgtacatgcagaagaatgctatatgctgcacattttgcctttaaagtcttacgactttccccattttagtctaatgggaagatacagatgtgcaagtctgcttttttgttttttgttattatttttttttttttgctctgtgttatggacattttcagacatgcacagaagtggagaggatggtccttggaccccatgtgtccatcacctagctgcatcacttatcagctatggtcaacctggtttcatctgtatctctctcttttcacctgtattgtttattgaaaatccaagacactatgccaatgcaaccgtgactactttgggagattggtagtctcttttgatggtgatagtgatggggtgcactatcataatcacatcaggtctgctttttgcttttaatgttaactaatgaagttccagagatgggccttagaaatgtgttttaagaattaacaaggagtctcaaaaagaaatgagagggatgcttcctttccccttgcatctacaaaacaagagagagactgttctgttgtaaaactctttcaaaaattctgatatggtaaggtacttgagacccttcaccagaatgtcaatctttttttctgtgtaacatggaaacttgtgtgaccattagcattgttatcagcttgtactggtctcataactctggttttggaagaataatttggaaattgttgctgtgttctgtgaaaataacctccccaaaataattagtaactggttgttctacttggtaatttgacaccctgttaataacgcaattatttctgtgttcttaaacagtataaatagttgtaagtttgcatgcatgatggaaaaataaaaacctgtatctctgttaaaaaaaaaaaaaaaaaaaaaaaaaaaaaaaaaaaaaa

SEQ ID NO: 171 - DNA, 2100 bp, Homo sapiens
  SITE (149): n equals a,t,g, or c
  SITE (164): n equals a,t,g, or c
tacttttagatttactgccttcaaaaagtgcctattctgagcaacataaacgttattccttacatatgtatgtacacacggtacccagagtcgtactgtggcagccttcaaaaacataccatcagaaagagtaggtgctgagataaggnaactttgccaaatgnaagaaagtcactcacttccaatatcccctcttcaagcggctaccgtgraasgggctgcaaacacattccctgagcatcccttgctgatacagcttctttatatttatatcctactggatggtagcatattgctaaggtttcctgtactctgcttcaagggaatgtaagytttatggcattgaaacatttaggaaaaaaaaagatgtttaagagaattaatagagccgtagtctgtattaggatgtgtgtcatatgtgtgttctataaactaagcatcggtgggtttagagtgttaaagtgtcagcacattccttctccttttgtctctcaggctaacatgagagaaaatagaaaagtcttggctgtggggattggaagctcagggggccaaatgtccttgccagatccttagagcattactttgactcctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaaaaagatcgttctcaatgtgtcgtctgactcaaccagctggcagattacacttgccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataacattccctgacttagggaaaggcacacaaaaacatataaagaatatgtctattttcatatgtgtgatactgacagagccatggtattcctaaaatataggtttctcttttttcttgtattcttagcaaattgcatttattcactacattacaaaccatcactgatgtatccaaaatagcacacatagttcagtatgaaaataagagaataaaatctgttataagcaagtgatttaggtattttcttttgtgtttatgcattatctgactatattaaaacctgtttttctatttaccttctatcagttttctctaccaattatgttttttcaatgctctataagaatgaatatggaaattatatttcttttttctgtaaaagagttgcaactactttattatatttagaaatccaataaacttcttattacatttaaaaaaaaaaaaaaaaaactcgaa

SEQ ID NO: 172 - DNA, 1930 bp, Homo sapiens
  SITE (8): n equals a,t,g, or c
  SITE (24): n equals a,t,g, or c
  SITE (1927): n equals a,t,g, or c
cctttgantgtggtcccgggtgcngattggcagcgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggsccaaacaagctgaagatgctgccaaaagcataaccaatgggcagtgatgatgggagcttcagccctccacctycacagcttcaaggaggcaagatggacgtytcycatagttgatycggrtgaagaagrttctccaataattgcccgacgttcattgaaggaaggaggaggaggcccgccaagaggggaatttaggnttg

SEQ ID NO: 173 - DNA, 1509 bp, Homo sapiens
  SITE (1494): n equals a,t,g, or c
ggccctggcctctgggctgaggcttgctagggactcggggtggctctaaggggcagggatagggctggggagcgccggcctgtggccctgaccagccccttctcgtgcrggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcagccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtcaaaaaaaaaaaaaaaaaaaaaaaaaaaaattnctgcggcctcaaggg

SEQ ID NO: 174 - DNA, 3173 bp, Homo sapiens
  SITE (3119): n equals a,t,g, or c
  SITE (3121): n equals a,t,g, or c
tcgaccccasgcgtccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacagaaattattatgaacggatacatgccttaggtccgaactacaatctggtcattagcgatctgaggatggaagacgcaggagactacaaagcagacataaatacacaggctgatccctacaccaccaccaagcgctacaacctgcaaatctatcgtcggcttgggaaaccaaaaattacacagagtttaatggcatctgtgaacagcacctgtaatgtcacactgacatgctctgtagagaaagaagaaaagaatgtgacatacaattggagtcccctgggagaagagggtaatgtccttcaaatcttccagactcctgaggaccaagagctgacttacacgtgtacagcccagaaccctgtcagcaacaattctgactccatctctgcccggcagctctgtgcagacatcgcaatgggcttccgtactcaccacaccgggttgctgagcgtgctggctatgttctttctgcttgttctcattctgtcttcagtgtttttgttccgtttgttcaagagaagacaagatgctgcctcaaagaaaaccatatacacatatatcatggcttcaaggaacacccagccagcagagtccagaatctatgatgaaatcctgcagtccaaggtgcttccctccaaggaagagccagtgaacacagtttattccgaagtgcagtttgctgataagatggggaaagccagcacacaggacagtaaacctcctgggacttcaagctatgaaattgtgatctaggctgctgggctgaattctccctctggaaactgagttacaaccaccaatactggcaggttccctggatccagatcttctctgcccaactcttactgggagattgcaaactgccacatctcagcctgtaagcaaagcaggaaaccttctgctgggcatagcttgtgcctaaatggacaaatggatgcatacccttcctgaaatgactcccttctgaatgaatgacaaagcaggttacctagtatagttttcccaaacttcttcccatcatagcacatgtagaaaataatatttttatggcacactgggataaacaagcaagattgctcacttctggaagctgcatatgactagaggcctcttgtgactggaggtaacaaccctgcccagtaactgtgggagaaggggatcaatattttgcacacctgtaataggccatggcacaccagccaagatgctctgctcacagtcagtatgtgtgaagatccctggtgcgtggccttcaccacgcatcttgagcaaattaggaaaatgtacccttcgcttgaggcagatgcagcccttcccccgagtgcatggcttggagagcagaatgtgggctgcatataagcacactcatccctttgtctgggaatctttgtgcagggcataacaggcttagtaagtccaaacacagatgacagtgctgtgtgggtctctgtcagagttgtggctctcagccatgtagacacactctccaaatggagtgttggaaaatgttctttctgcagggtctagagactgctgggacacttttcttggagtgctacttcagaagccttataggattttctttctggccaagatttccttctgtatcactccaagcagcctcagcagaagaagcagccatgcccagtattcccactctccaaaaggaactgaccagcttatatttctcacacttctggggaactgggtataatccaaccatcaaaatagaagaccttgcaagaagcagagtcattctccagaaggaacttgggagatgatggtgcagatgatgaaactgggttcatcccagttccaaagactcagagaactagagtttaagctgaggcagagtgccgccaccctggcatgccccacaaacagatcaccagccagcttacacaggcattaactctcctcaatgaggaagaatcattcacaactgagcaagacattcatatgatcatttaaggaagtgtttcccttatgtgttagcaagtataatcggctaactcctaaatcccaatgaatagtcctaggctggacagcaatgggctgcaattaggcagataaagacatcagtcccagtaaatgaatccatagactcatctagcaccaactaccattagcactatgttaggagctgcaaggccccaaagtagaagatgtgcataatgtctgctcttgtgtagctcaggagacaattccagcacagacactacagttaacgctgaactgcagctgcaagtaatagcatgaacagtcagaaaaataccttatgagggggcagggctgaagctgggccttgaaggatggatgaaatttggatagagaatgaggaagacagagggcctccaagtgagagaagcatgaaaaatgagcaggggcctggatcagtggggtgtattcagagcacctctccagatgcaccatgcatgctcacagtcccttgcctatgtgtggcagagtgtcccagccagatgtgtgcccccaccccatgtccatttacatgtccttcaatgcccacctcaaaaggtacctcttctgtaaagctttccctggtatcaggaatcaaaattaatcagggatcttttcacactgctgttttttcctctttggtccttctatcactaaaactcatctcattcagccttacagcataactaattatttgttttcctcactacattgtacatgtgggaattacagataaacggaagcckgctggggtggtggctcacgcctgtaatcccaacactttgggaggccaaggcaggcggatcacctgaggtcaggarttcgagattartctggccaacatggtgaaaccccatntntactaaaaatacgaaattagccaggtgtggtggcacacatctgtagtcccag

SEQ ID NO: 175 - DNA, 991 bp, Homo sapiens
aaattcggcacagctgagaggagacacaaggagcagcccgcaagcaccaagtgagaggcatgaagttacagtgtgtttccctttggctcctgggtacaatactgatattgtgctcagtagacaaccacggtctcaggagatgtctgatttccacagacatgcaccatatagaagagagtttccaagaaatcaaaagagccatccaagctaaggacaccttcccaaatgtcactatcctgtccacattggagactctgcagatcattaagcccttagatgtgtgctgcgtgaccaagaacctcctggcgttctacgtggacagggtgttcaaggatcatcaggagccaaaccccaaaatcttgagaaaaatcagcagcattgccaactctttcctctacatgcagaaaactctgcggcaatgtcaggaacagaggcagtgtcactgcaggcaggaagccaccaatgccaccagagtcatccatgacaactatgatcagctggaggtccacgctgctgccattaaatccctgggagagctcgacgtctttctagcctggattaataagaatcatgaagtaatgtcctcagcttgatgacaaggaacctgtatagtgatccagggatgaacaccccctgtgcggtttactgtgggagacagcccaccttgaaggggaaggagatggggaaggccccttgcagctgaaagtcccactggctggcctcaggctgtcttattccgcttgaaaatagccaaaaagtctactgtggtatttgtaataaactctatctgctgaaagggcctgcaggccatcctgggagtaaagggctgccttcccatctaatttattgtgaagtcatatagtccatgtctgtgatgtgagccaagtgatatcctgtagtacacattgtactgagtggtttttctgaataaattccatattttacctaaaaaaaaaaaaaaaaaactcgagggggggcccgtacccaattt

SEQ ID NO: 176 - DNA, 1290 bp, Homo sapiens
  SITE (1253): n equals a,t,g, or c
  SITE (1257): n equals a,t,g, or c
  SITE (1259): n equals a,t,g, or c
  SITE (1266): n equals a,t,g, or c
acagccctcttcggagcctgagcccggctctcctcactcacctcaacccccaggcggcccctccacagggcccctctcctgcctggacggctctgctggtctccccgtcccctggagaagaacaaggccatgggtcggcccctgctgctgcccctrctgcycctgctgcwgccgccagcatttctgcagcctrgtggctccacaggatctggtccaagctacctttatggggtcactcaaccaaaacacctctcagcctccatgggtggctctgtggaaatccccttctccttctattacccctgggagttagccayagytcccracgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgttyattatagcagtgcaaagagttcctttatcctccccaaggatggaaaatacaatttattttgcttaccatacaccccttttctcctcgtccacattttccaatctgtatggtggctgtcttctatggcagaaggttttggggaataaatagcgtganatgntnctgactnaaaaaaaaaaaaaaaaaaactcga

SEQ ID NO: 177 - DNA, 2290 bp, Homo sapiens
  SITE (1011): n equals a,t,g, or c
tggggccccttttggatgctctgggtgtttttgccaagagttacaggatgtcaagtgtggggagctcagcacccttgctgtggaccagtgaaggctgttccagaccaggtgcttccagacatttccaggctccaggagagaggctgggagcccccacagaaagcacaggaaaatgcaaaaaaaaaacagtcttttttttttttttgctttttattatgaaaacaaaacaaatgccccaggagaagggtccatgattaccagaaacatcaaagagtactttctaccatttttattctgttgtgttgaggccagcattgcaataaacaagctaaactacttacattggactcattttcagtaactgacatttacaggaatatactagaaacggcactaaaaagtttaagaaaagttacggtaaacttgcatgcacatcatacagaaaagtaacattttaaatataaaaaagaaaaacttcctggaagcattatgccagtattaaggaacagtgctactctggatgtgacaaattctgtatgtgggtgttactctttcccaaaagactgtcagaggcgtgagtgctgcaaaagaacaacaacaaaaacaaacacacaaaaaaatgtgtcttacagtttgtaagcaagatgacactgcccaacacaaagaggggtctggagttcagttcacgcccgaagcctgccccctcggcctccaggggtcattcagagtgttctcaaatccaattccgacacacgacttgtcactactcctctccccttgaaaaaagcatgttagaagctgccctacaggtctcagcagtgggacaatctaattgaatcaccgcagccttctaatacagaagaaacggacgtgactgtcaccctcagcccgccagcaagggcgctgaggaagtcattaatccttcgaaactctgaaaagaaaccagtgttgaagtctggacagaaagccttaaaaaagtgacagcaccaatgcagctgctcagtgtacccnccgtgggctgtcagggtcagtggcttctttctagatgaaaggagcagaggcgagccgacgccaccgtcacagagaaccagccgagaaggaaaggccccacgatgctccctgtgcgctgcccccacagccggccgctcccccgacggctcacacaggcagcacctcactgccctgtggctggaggggcattgcaaggagcgccccccagccccaggcacccccggcttagggtgtacgtatcacccagccctgtgctggcagcacgttaccaaccagcctgcgtgaagacctgtcaactgtcgtgtgtgaattccttaaattcggtttaaatagtccattaaagatctgtttagaaaatacctttgaaaacgagggtaactttaaaaaatggaaactttcaaatccatttatatttttattataaacaaaacttaattaaaagtttaacaaactggctgaaaactcaccaagtgtcagactcaccagcaatttaaaaaatgataatttaccagcatctcctcatcagagttccctctccagtaagggtatacctacatctgtaagggtcagtggactctgaatcaattttatggttgttttaaaatcaccgtgtattaggatactaatgatagtccctatatccatccagaaatgctggcagaaagcactggccaccatacaggacagaccacaccacagctccatacccagcgtctgcctggaggctcccccacgctgaggtccgggagaatgcctggtttcagtcatttccggactaactgtgacaacgcgtgagcagggagcaccgtgcgagtctccgggagggaatcctcctggggcccagagactcctccacccctggggagggcagacaggctcgggarggcctggccaggccactggaggctggcagggagcaggcatgtccacccgcaagcctgggaggctaactctggcattcctggccggagccgccatgctcattggtgggccagtttgggacatccccgtactcaaagaccatatggcagcctctgggaaaacaaaaccaaaacatcaccttctattaaactctgtatattattattttttacaatagaaagttaaaaatcaagacttagatttactatacattttttctctcagattacaaagtttatattatataactggggttccctaaattgatttcttttaaaacagtcttaaagagaccagaagtgaatacaaaagaactaaacaaaataaaaaattagaatgtgctgtagctgaaagctgt

SEQ ID NO: 178 - DNA, 549 bp, Homo sapiens
ggcacgagccatgcctggcctctccttgattcttacagtcactttgttggctgtttctgactcagcagctacctgcattgtggccaaaggatgacctattccttctcaggagggcaaaaatgtggaatagtgtctgtccatgcctctcctcatgggctaccacctctgccaccgtggttaatcagtaacaaccaggagagaagctgctggaactgacctctgggaactccctgggatggtttggtgcaggaatgtagtaggcatacacgtggttgcgtggatctgggccctcctgatgtgagtagagaggtaaaaggccaccatctccttgacctctggggaactcatccacaaagaagatgtttccaagatgcttctgaagattgcctaaaaatagccggtttccacccccgtgaatgcatccattctagaatgctccttcaccaggaccagagaactgatttacagaagtgacatgaaaacattccatcccagaatttgcagtagctcaaattaagtttctagctattaaaaagaaaaaaaaaaaaa

SEQ ID NO: 179 - DNA, 1509 bp, Homo sapiens
  SITE (517): n equals a,t,g, or c
  SITE (1509): n equals a,t,g, or c
ggcacgagggctcattcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcangagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcracagggccacgcggascytcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctggaaaaaaaaaaaaaaaaaaaaaaaaaaaaaaaaaaaaaaaaaaaaaaaaaaaaaaaaaaaaaaaaaaaaagaaaaaan

SEQ ID NO: 180 - DNA, 1316 bp, Homo sapiens
  SITE (221): n equals a,t,g, or c
  SITE (574): n equals a,t,g, or c
  SITE (1260): n equals a,t,g, or c
  SITE (1291): n equals a,t,g, or c
  SITE (1301): n equals a,t,g, or c
  SITE (1313): n equals a,t,g, or c
agctgtatcataggaaagatggccacaccggcggtaccagtaagtgctcctccggccacgccaaccccagtcccggcggcggccccagcctcagttccagcgccaacgccagcaccggctgcggctccggttcccgctgcggctccagcctgcatcctcagaccctgcggcagcagcggctgcaactgcggctcctggccagaccccggcctcagcgcaantccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacatcacagagcactctgtgctgnatccatgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaattaaaaaaaaaaaaaaaaaccnsgrgggggggcccggtcccattssccctttngtaattcgtnttacaatccccnggc

SEQ ID NO: 181 - DNA, 777 bp, Homo sapiens
ggcatgwkcagacatgacttctattgccaggctggtcaagtggcagggtcatgagggagacatcgataagggtgctccttatgctccctgctctggaatccaccagcgggctatctgcgtttatggggctggggactagaattggatgcttcaaaaccatcacctgttggccaacaagtttgacccaaaggtagatgataatgctcttcagtgcttagaagaatacctacgttataagggccattctattgggacctgaactttgaagaccacamtattgaagaggcgttgcttaccygttgggggccaagaggcatgttaccaaacatggyycargaamyttggykgggamcarkkkkggkkgggarrmcmrgggyttgscaawttcskkggcmwccytttagggtaarrrgggckgtwattagattgtgggtaaagtaggatcttttgcccttgcaaatttgctgcctgggtgaatgytgcttgttccttctcmacccctaaccctagtagttcctccactaactttctcactaagtgagaatgagaactgctgtgatagggagagtgaaggagggatatgtggtagagcacttgatttcagttgaatgcctgctggtagcttttccattctgtggagctgccgttcctaataattccaggtttggtagcgtggaggagaactttgatggaaagagaaccttcccttctgtactgttaacttaaaaataaatagctcctgattcaaagtaaaaaaaaaaaaaaaaaaaaaaaaaa

SEQ ID NO: 182 - DNA, 791 bp, Homo sapiens
  SITE (315): n equals a,t,g, or c
  SITE (340): n equals a,t,g, or c
ggcacagataactatgtacatgtattccttaaatgtttttttaagttttatattcttggcactggtcttcaaatgtgtacatgtgtgccagggagcaaatgccttcttgtttctgaaattggtcttttagactgttcttttttcccatcttctcacctcctgcccctccttcagggtacttccgtggccagaacccctccaggtcagaggcagaagagaagcctcatgggtcacagcagcagatgtgggctggagatctattcatttggttttggcttgaattttctgratggtttacttgatcytgggaaaganatatcttgccaggaaaaatgatagnccttgacaatgttgaatgatcctgcaccaccttgaaagacatttctaatatggtttgtcaggcaaagtggttagtagtcatttgtggcctgaggtagaagtcctcagaaatcagcagacttcactgataaaatgctgacttgcccctggactgggctctgtgagagtggccttctgcactgtgcacagtaggtgtgaacacaccacacctacagggaccacgtggtgggctgtggactagcggccaagctccctgcaggcccactaatagaattcagcttttagcatgggctgtttcatactgttctgatgaaactgatttggtttctttcctccataccccttctgcatttcagtgtttttgtttagttttcctggtttttaattataactacaaaataaaatctttaggctattcaccttagcttagtaaaaaaaaaaaaaaaaaactc

SEQ ID NO: 183 - DNA, 1405 bp, Homo sapiens
  SITE (1359): n equals a,t,g, or c
aaattgattaacagcttgaaagaaggctctggttttgaaggcctagatagcagcactgccagtagcatggagctggaagaacttcggcatgagaaagagatgcagagggaggaaatacagaagctgatgggccagatacatcagctcagatccgaattacaggatatggaggcacagcaagttaatgaagcagaatcagcaagagaacagttacaggwtctgcatgaccaaatagctgggcagaaagcatccaaacaagaactagagacagaactggagcgactgaagcaggagttccactatatagaagaagatctttatcgaacaaagaacacattgcaaagcagaattaaagatcgagacgaagaaattcaaaaactcaggaatcagcttaccaataaaactttaagcaatagcagtcagtctgagttagaaaatcgactccatcagctaacagagactctcatccagaaacagaccatgctggagagtctcagcacagaaaagaactccctggtctttcaactggagcgcctcgaacagcagatgaactccgcctctggaagtagtagtaatgggtcttcgattaatatgtctggaattgacaatggtgaaggcactcgtctgcgaaatgttcctgttctttttaatgacacagaaactaatctggcaggaatgtacggaaaagttcgcaaagctgctagttcaattgatcagtttagtattcgcctgggaatttttctccgaagataccccatagcgcgagtttttgtaattatatatatggctttgcttcacctctgggtcatgattgttctgttgacttacacaccagaaatgcaccacgaccaaccatatggcaaatgaaccaagcccagttgttgcagtgattggttgtctttttctagacttgggatctgcaagaaggccaattgcctaaaatttctgagaacagtgcacaagattattttatcactacaagcttttaactttttaagttattgtacaagtattctacctaaatcttccaatttcctttaaatggtaagagtttctaaaacagacaataatttaacaagctcagctctgctttatctgagtttagtggtcctaatatatatgtagagaaagatggtggggttgttcacctctgtacagaccatctgtatgttaggtgacattgattatgggttataatcagggaaactaattgtatttagtgacaaaaataaaaagttttttttttataattcagtctgcttttggattttcatatatttaactttgcaaaaagatttactttgtacatgttacaggcttgattggtgtaaatctttttataaatacataaataaaagnaaaatatgcatttttcttttctaaaaaaaaaaaaaaaaaaactcga

SEQ ID NO: 184 - DNA, 1596 bp, Homo sapiens
  SITE (1571): n equals a,t,g, or c
  SITE (1577): n equals a,t,g, or c
  SITE (1588): n equals a,t,g, or c
  SITE (1596): n equals a,t,g, or c
gtcatgcagtgcgccggagaactgtgctctttgaggccgacgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatattttttkggagtgcagmmtawtgtaattaragcattccagtaanagtgtntttaaagttgntctatatn

SEQ ID NO: 185 - DNA, 2293 bp, Homo sapiens
gcgcagagcccgyacgagcaggacgacgacgacaagggcgactccaaggaaacgcggctgaccctgatggaggaagtgctcctgctgggcctcaaggaccgcgarggttacacatcattttggaatgactgtatatcatctggattacgtggctgtatgttaattgaattagcattgagaggaaggttacaactagaggcttgtggaatgagacgtaaaagtctattaacaagaaaggtaatctgtaagtcagatgctccaacaggggatgttcttcttgatgaagctctgaagcatgttaaggaaactcagcctccagaaacggtccagaactggattgaattacttagtggtgagacatggaatccattaaaattgcattatcagttaagaaatgtacgggaacgattagctaaaaacctggtggaaaagggtgtattgacaacagagaaacagaacttcctactttttgacatgacaacacatcccctcaccaataacaacattaagcagcgcctcatcaagaaagtacaggaagccgttcttgacaaatgggtgaatgaccctcaccgcatggacaggcgcttgctggccctcatttacctggctcatgcctcggacgtcctggagaatgcttttgctcctcttctggacgagcagtatgatttggctaccaagagagtgcggcagcttctcgacttagaccctgaagtggaatgtctgaaggccaacaccaatgaggttctgtgggcggtggtggcggcgttcaccaagtaactctgctcggggtgaaccattctcctttctctcaagtaaaccagtagtttttcttctgttgacttctggttttctgtaatttgtactttcccacactataattggcttctgttttacaaaatggtgggtggctttttcttttttgtacgtgtacaggattctgctggtacgagaggccttcctctttctgtttttaaaaaaagttttactgccatattggcattccattccctgttgccatcctcactgttacctgttttgggtttctggtctactttgactttcaaagtacctccagcctcctcatacgcacagcttttggatgacctcagcttgagtttctccatatgtgcatgtacatctagcattctgcctacagttcagacagaagtcacaaaaaggccttcaactcaccaaaggtaaatatctgtatctattaggacattttttacatagacttcagttgagatgtatacttagcaaaattatttttaaattgaaacagcacagtaaatacttaatataaaatgtcccttggattttgcttcccatgtaaatctattgtattattacacttgttataattttaactataaaggtccaattgtttcacagagccagtttgggatgggctgcattccatttatgctgtatatagtttgaattatatataaattaccccttcttctggccacccctgctcccatcttagtattttgcaagatctaatcagttgtacacctggtgcccctcgcttgcttcaatcatggttatttgatggcaaaatcgacctcttgtcgctgaaggagagagaaaagatgtgtgtctgattggtcctgggattttttgagctgtgccatttatggtactctttgcctatgcatcccctttttagattttttttaaattttatcttactgtttttataatttctattgggaagaggcttgtgaccagtaccaatcttgagtttctttttctgtccacaagtaaattaatatctgctctgaaatgtcatttatctactcacacattcttggggaaaaaaatcaaatgtcagtcctagcagatgttgcatgtaaattggtagcaagtaatgattacaacccagaggattaagaattttgtaacagaaagctctatgttttaattttttatatacaattaggataattagcattgtcagactataaacctttgctttttaaagtttatttttactatttctttatcactttattgtatcatcaccattggtttcataatgtaaatactatatgttgaacaaattaaatgtcaaaattttttattaccatagtccatgttaatagtggggctttcaggtgtttagagattttttttgttgttgttaacattcattgcaaaagtactagatggtgtataactctagagttgaattttaagggattccctaatatgtatactatctttttatctgaagtaataaataaacaatgatcttgaaagtgccyraaamaaaaaaaaaaaaaaaaaa

SEQ ID NO: 186 - DNA, 1212 bp, Homo sapiens
  SITE (1212): n equals a,t,g, or c
ggcacgaggcgagccggcgcaccgtacgctgggacgtgtggtttcagctcgtgcgcctccccgtgggtttgcgacgtttagcgactattgcgcctgcgccacgccggctgcgagactggggccgtggctgctggtcccgggtgatgctaggcggctccctgggctccaggctgttgcggggtgtaggtgggagtcacggacggttcggggcccgaggtgtccgcgaaggtggcgcacatgggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaatgcaaaaaaaaaaaaaaaaaaaaaaaaaaaaaaaaaaaaaaaaaaaaaaaaaaaaaan

SEQ ID NO: 187 - DNA, 1605 bp, Homo sapiens
  SITE (1363): n equals a,t,g, or c
gcttccggaagttgcttttgtccaaacatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaacagggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcntgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctggaaaaaaaaaaaaaaaaaaaaaaaaaaaaaaaaaaaaaaaaaaaaaaaactcgag

SEQ ID NO: 188 - DNA, 1516 bp, Homo sapiens
attcggcatgagggggtcacgtggtggctgggccggggaaatggcggcttcaggagagagcgggacttcaggcggcggaggcagcaccgaggaagcatttatgaccttctacagtgaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactgtgaaagagcgaaaaaaacaattaaagaaggaaggaaaacctacaattgtagaggaggatgatcctgagctgttcaaacaagctgtatataaacagacaatgaaactctttgcagagctggaaattaaaaggaaagagagagaagccaaagagatgcatgaaaggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctgccttctcttcccacagcctgtaactcagtgttttgtacttcactgaattgtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaaaaaaaaaaaaaaaaaaaactcga

SEQ ID NO: 189 - DNA, 681 bp, Homo sapiens
  SITE (152): n equals a,t,g, or c
gctcccatgttgctggctgtccgtacatcaccctgtcccctgcaggagggggctacaggccatctccctcctgtaggcctctgactcccctccacttttgggccctcagcttatctcgggcaggggaccattgcagcatcctcccctcctcnggactcaaggtgctgaggtataagccctgggccccagatccctgrtkacaccttcctggagaagactctcaaaagtgactgtatatttgagttcaccagcaataactccccacactcgaagcaggtccaaacccmaggatcccagggtccttgggctctgtggcactgtcttcccaagatccttcctgttgcacaatgggaaacctaagaggaaaaagacaggggcctgcttgcccagccatgcgagggattccatgcccacctgccctctgyctgcctcgctggaatgtgggcccctgctccccgtcaggttgtgctgtctctgacctatgtttacatccccgaggggtttctgcctcctccccacccaggtcagggtgtggtccagcagcttgctgtggggtgctgacatgtgtcaccactgccccccttgcccccgggggggtcatggtctcctcctggatgctgctccttgaatyttttttyttgawaaaccytttamaattaaaaaaaaaaaaaaaaaactcga

SEQ ID NO: 190 - DNA, 1014 bp, Homo sapiens
  SITE (1005): n equals a,t,g, or c
gcctcaagccacgcatatgataattttctggaacattcaaattcagtgtttctacagccagttagtctacaaaccattgcagcagcaccatcaaaccagagtctgccactttttgtcatcgctggatgattgctgggcaaaggtggccttttagagctcttaaaagcccacaaaaaggctattcgtagagccacagtcaacacatttggttatattgcaaaggccattggcctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgtrtttgagacatctcctcatgtaattcaggcagttatgggagccctagagggcctgagagttgctattggaccatgtagaatgttgcaatattgtttacagggtctgtttcacccagcccggaaagtcagagatgtatattggaaaatttacaactccatctacattggttcccaggacgctctcatagcacattacccaagaatctaccaacgatgataagracacctatattcgttatgaacttgactatatcttataattttattgttwatttkgtgkttaatgcacastacttcacaccttaaacttgctttgatttggtgatgtaaacttttaaacattgcagatcagtgtaggactggtccataggggaagagctaggaantccataggc

SEQ ID NO: 191 - DNA, 2779 bp, Homo sapiens
  SITE (318): n equals a,t,g, or c
  SITE (2003): n equals a,t,g, or c
  SITE (2004): n equals a,t,g, or c
tcgcagcagggtgtgtccagatggtcagtctctggtggctagcctgtcctgacaggggagagttaagctcccgytctccaccgtgccggctggccaggtgggctgagggtgaccgagagaccagaacctgcttgctggagcttagtgctcagagctggggagggaggttccgccgctcctctgctgtcagcgccggcagcccctcccggcttcacttcctcccgcagcccctgctactgagaagctccgggatcccagcagccgccacgccctggcctcagcctgcggggctccagtcaggccaacaccgacgcgcantgggaggaagacaggacccttgacatctccatctgcacagaggtcctggctggaccgagcagcctcctcctcctaggatgacctcaccctccagctctccagttttcaggttggagacattagatggaggccaagaagatggctctgaggcggacagaggaaagctggattttgggagcgggctgcctcccatggagtcacagttccagggcgaggaccggaaattcgcccctcagataagagtcaacctcaactaccgaaagggaacaggtgccagtcagccggatccaaaccgatttgaccgagatcggctcttcaatgcggtctcccggggtgtccccgaggatctggctggacttccagagtacctgagcaagaccagcaagtacctcaccgactcggaatacacagagggctccacaggtaagacgtgcctgatgaaggctgtgctgaaccttaaggacggggtcaatgcctgcattctgccactgctgcagatcgaccgggactctggcaatcctcagcccctggtaaatgcccagtgcacagatgactattaccgaggccacagcgctctgcacatcgccattgagaagaggagwctgcagtgtgtgaagctcctggtggagaatggggccaatgtgcatgcccgggtctgcggcgcttcttccagaagggccaagggacttgcttttatttcggtgagctacccctctytttggccgcttgcaccaagcagtgggatgtggtaagctacctcctggagaacccacaccagcccgccagcctgcaggcactgactcccagggcaacacagtcctgcatgccctagtgatgatctcggacaactcagctgagaacattgcactggtgaccagcatgtatgatgggctcctccaagctggggcccgcctctgccctaccgtgcagcttgaggacatccgcaacctgcaggatctcacgcctctgaagctggccgccaaggagggcaagatcgagattttcaggcacatcctgcagcgggagttttcaggactgagccacctttcccgaaagttcaccgagtggtgctatgggcctgtccgggtgtcgctgtatgacctggcttctgtggacagctgtgaggagaactcagtgctggagatcattgcctttcattgcaagagcccgcaccgacaccgaatggtcgttttggagcccctgaacaaactgctgcaggcgaaatgggatctgctcatccccaagttcttcttaaacttcctgtgtaatctgatctacatgttcatcttcaccgctgttgcctaccatcagcctaccctgaagaagcaggccgcccctcacctgaaagcggaggttggaaactccatgctgctgacgggccacatccttatcctgctaggggggatctacctcctcgtgggccagctgtggtacttctggcggcgccacgtgttcatctggatctcgttcatagacagctactttgaaatcctcttcctgttccargccctgctcacagtggtgtcccargtgctgtgtttcctggscatcgagtggtacctgcccctgcttgtgtctgcgctggtgctgggctggctgaacctgctttactatacacgtggcttccagcacacaggcatctacagtgtcatgatccagaagccctggtgagcctgagccaggannttggcgccccgaagctcctacaggccccaatgccacagagtcagtgcagcccatggagggacaggakgacgakggcaacggggcccagtacaggggtatcctggaagcctccttggagctcttcaaattcaccatcggcatgggcgagctggccttccaggarcagctgcacttccgcggcatggtgctgctgctgctgctggsctacgtgctgctcacctacatcctgctgctcaacatgctcatcgccctcatgagcgagaccgtcaacagtgtcgccactgacagctggagcatctggaagctgcagaaagccatctctgtcctggagatggagaatggctattggtggtgcaggaagaagcagcgggcaggtgtgatgctgaccgttggcactaagccagatggcagcccsgatgagcgctggtgcttcagggtggaggaggtgaactgggcttcatgggagcagacgctgcctacgctgtgtgaggacccgtcaggggcaggtgtccctcgaactctcgagaaccctgtcctggcttcccctcccaaggaggatgaggatggtgcctctgaggaaaactatgtgcccgtccagctcctccagtccaactgatggcccagatgcagcaggaggccagaggacagagcagaggatctttccaaccacatctgctggctctggggtcccagtgaattctggtggcaaatatatattttcactaactcaaaaaaaaaaaaaaaaaaaaaaaaaaaaaaaaaaaaaaaaaaaggc

SEQ ID NO: 192 - DNA, 1923 bp, Homo sapiens
  SITE (1900): n equals a,t,g, or c
acccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggctggttgcagtctagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccstgctgtcacttacatctataactgggcctacggctttgggtgggcagccacgattatcctgatyggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcatttcagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattaggagggtcattcttgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattctaaaaaaaaaaaaaaaaaactngagggggggcccggtacccaatt

SEQ ID NO: 193 - DNA, 2346 bp, Homo sapiens
  SITE (220): n equals a,t,g, or c
  SITE (515): n equals a,t,g, or c
aggctcagggggacactctcaaaattacacagcttttaacaggtggcagaattggggttcagacccagatctgggttcaagtcactcatggtgtgattgcggcattccttcccgcatctgggccttgccatctctctctccgagtggacatggagaggacgggggcccagcagctggatggctgcaggggatcaagtcttctctggggctgggcacgtanaagagcatgtggctggtggacggcatgcctggctcctcacctggcagtctgcctgccctgctaaccggctgtctcttgttcccctagtgccctcggctagcatgacccgcctgatgcgwtsccgcacagcctctggttccagcgtcattctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagngccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtacagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcracaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcaaaaaaaaaaaaaaaaaaaaaaaaaaaaaaaaaaaaaaaaaaaaaaaaactcgaggggggcccgtacccaattcgccgtatatgatcgtaaacaatc

SEQ ID NO: 194 - DNA, 3054 bp, Homo sapiens
  SITE (80): n equals a,t,g, or c
  SITE (1968): n equals a,t,g, or c
  SITE (2645): n equals a,t,g, or c
  SITE (3034): n equals a,t,g, or c
  SITE (3047): n equals a,t,g, or c
tatctgaaccaccctttattctacatatgataggcagcactgaaatatcctaaccccctaagctcmaggtgccctgtggnacgagcaactggactatagcagggctgggctctgtcttcctggtcataggctcactctttcccccaaatcttcctctggagctttgcagccaaggtgctaaaaggaataggtaggagacctcttctatctaatccttaaaagcataatgttgaacattcattcaacagctgatgccctataacccctgcctggatttcttcctattaggctataagaagtagcaagatctttacataattcagagtggtttcattgccttcctaccctctctaatggcccctccatttatttgactaaagcatcacacagtggcactagcattataccaagagtatgagaaatacagtgctttatggctctaacattactgccttcagtatcaaggctgcctggagaaaggatggcagcctcagggcttccttatgtcctccaccacaagagctccttgatgaaggtcatctttttcccctatcctgttcttcccctccccgctcctaatggtacgtgggtacccaggctggttcttgggctaggtagtggggaccaagttcattacctccctatcagttctagcatagtaaactacggtaccagtgttagtgggaagagctgggttttcctagtatacccactgcatcctactcctacctggtcaacccgctgcttccaggtatgggacctgctaagtgtggaattacctgataagggagagggaaatacaaggagggcctctggtgttcctggcctcagccagctgcccacaagccataaaccaataaaacaagaatactgagtcagttttttatctgggttctcttcattcccactgcacttggtgctgctttggctgactgggaacaccccataactacagagtctgacaggaagactggagactgtccacttctagctcggaacttactgtgtaaataaactttcagaactgctaccatgaagtgaaaatgccacattttgctttataatttctacccatgttgggaaaaactggctttttcccagccctttccagggcataaaactcaaccccttcgatagcaagtcccatcagcctattatttttttaaagaaaacttgcacttgtttttctttttacagttacttccttcctgccccaaaattataaactctaagtgtaaaaaaaagtcttaacaacagcttcttgcttgtaaaaatatgtattatacatctgtatttttaaattctgctcctgaaaaatgactgtcccattctccactcactgcatttggggcctttcccattggtctgcatgtcttttatcattgcaggccagtggacagagggagaagggagaacaggggtcgccaacacttgtgttgctttctgactgatcctgaacaagaaagagtaacactgaggcgctcgctcccatgcacaactctccaaaacacttatcctcctgcaagagtgggctttccagggtctttactgggaagcagttaagccccctcctcaccccttccttttttctttctttactcctttggcttcaaaggattttggaaaagaaacaatatgctttacactcattttcaatttctaaatttgcaggggatactgaaaaatacggcaggtggcctaaggctgctgtaaagttgaggggagaggaaatcttaagattacaagataaaaaacgaatcccctaaacaaaaagaacaatagaactggtcttccattttgccacctttcctgttcatgacagctactaacctggagacagtaacatttcattaaccaaagaaagtgggtcacctgacctctgaagagctgagtactcaggccactccaatcaccctacaagatgccaaggaggtcccaggaagtccagctccttaaactgacgctagncaataaacctgggcaagtgaggcaagagaaatgaggaagaatccatctgtgaggtgacaggcaaggatgaaagacaaagaaggaaaagagtatcaaaggcagaaaggagatcatttagttgggtctgaaaggaaaagtctttgctatccgacatgtactgctagtacctgtaagcattttaggtcccagaatggaaaaaaaaatcagctattggtaatataataatgtcctttccctggagtcagtttttttaaaaagttaactcttagtttttacttgtttaattctaaaagagaagggagctgaggccattccctgtaggagtaaagataaaaggataggaaaagattcaaagctctaatagagtcacagctttcccaggtataaaacctaaaattaagaagtacaataagcagaggtggaaaatgatctagttcctgatagctacccacagagcaagtgatttataaatttgaaatccaaactactttcttaatatcactttggtctccatttttcccaggacaggaaatatgtccccccctaactttcttgcttcaaaaattaaaatccagcatcccaagatcattctacaagtaattttgcacagacatctcctcaccccagtgcctgtctggagctcacccaaggtcaccaaacaacttggttgtgaaccnaactgccttaaccttctgggggagggggattagctagactaggagaccagaagtgaatgggaaagggtgaggacttcacaatgttggcctgtcagagcttgattagaagccaagacagtggcagcaaaggaagacttggcccaggaaaaacctgtgggttgtgctaatttctgtccagaaaatagggtggacagaagcttgtggggtgcatggaggaattgggacctggttatgttgttattctcggactgtgaattttggtgatgtaaaacagaatattctgtaaacctaatgtctgtataaataatgagcgttaacacagtaaaatattcaataagaagtcaaaaaaaaaaaaaaaaaactcgagggggggcccggtacccaatttnccaaatagagatngtattac

SEQ ID NO: 195 - DNA, 907 bp, Homo sapiens
  SITE (18): n equals a,t,g, or c
  SITE (89): n equals a,t,g, or c
ggcagagctcgtggccgnaactttttctgctcctggctgccacctactggctggccgcggccctggcctgggcctgcaccagcctgcgngcgggctcccacagcagcccccttccaagcagcgtccccacaccgcgcaccttctgcgggaacgtgctcgccgtgccggggaccatatggacggaaggctttgtgctcacctacaagctgggtgagcagggtgccagcagcctgttgatcctcttggctcctgctggagcacgagcggcgtttctgctcccgagttgggactgtggaatggtgtgggtgctgtggtctgctccatcgctggctcctccctgggtgggaccttgctggccaagcactggaaactgctgcctctgtgaggtcggtgctgcgcttccgcctcgggggcctagcctgtcagactgccttggtcttccaccttggacaccctgggggccagcatggacgctggcacaatcttgagagggtcagccttgctgagcctatgtctgcagcacttcttgggargcctggtcaccacagtcaccttcactgggaatgatgcgctgcagccagctggcccccagggccttgcaggccacacactacagccttctggccacgctggagctgctggggaagctgctgctgggcactytggscggagggcctggctgatgggttggggccacatccctgcttcttgctcctgctcatcctctctgcctttcccgttctgtacctggacctagcacccagcacctttctctgagctgagtggctggagtggtcaataaagccacatgtgcctgtggcccaaaaaaaaaaaaaaaaaaaaaaaaaaaaaaaaaactggagggggggcccggtacccaaatcgccggatatgatcgtaaacaatc

SEQ ID NO: 196 - DNA, 1290 bp, Homo sapiens
  SITE (871): n equals a,t,g, or c
  SITE (964): n equals a,t,g, or c
  SITE (1169): n equals a,t,g, or c
  SITE (1172): n equals a,t,g, or c
  SITE (1182): n equals a,t,g, or c
  SITE (1189): n equals a,t,g, or c
  SITE (1226): n equals a,t,g, or c
  SITE (1243): n equals a,t,g, or c
  SITE (1259): n equals a,t,g, or c
  SITE (1267): n equals a,t,g, or c
  SITE (1286): n equals a,t,g, or c
  SITE (1290): n equals a,t,g, or c
ggcacgaggagggacagggagtgggcaaggggaagaagcagcttatttgactaaccagcccctctgtggtccaccagcgtcttggcttggtgggagggctctcaatcagcagggccccagkagggcaagaagaagtggggcaaagcctggcgctcggccgcggtcgcggcagctttgcmatctggagccacgcctcctccaggccatgctccttgaacttggaaatgtcaaccggagcccttaacaccagccctccagcatctaatagacttgaatctactctaaacgaatatttaatccaacctcaactacattgtagctcagtccaacgactaaccctgaaatgggggtgttccagccttcagcgagatggccaagcggtcccctgggggctgtggcagcgggcttatccttctctgttgccaaccttgccgtccgacctcctccgcccccatgcggtgaccccgtccgtgtctgtgtctgtccatacgtgtgagtccagctaaaaagacaaaacagaacccgtgggcccagctcggaaggtgcgtggagaaggctccgacgtctccgaagtgcagcccttgggatggcattccgttgtgtgccttattcctggagaatctgtatacggctcgcctataagaaatatagcctcttcatgctgtattaaaaggacttttaaaagcaaaaaaaaaaaaaaaaaaactcgagggggggcccggtacccaattcgcccaatagtgagtcgtattacaattcactgggccgtcsttttaacaacgtcgtgaactgggaaaaccctggcgtttacccaacttaatcgccttgcagcacatccccctttcgccagctggcgttaatagcgaaaaangcccgcacccgaatcgcccttcccaacagtttgcgcagccctgaatggcgaaatggcaaattgtaagcgtttaatattttkkttaaaattccncgttwaawtttttgtttaaatcarctcaatttttttaacccaataagsccgaaatccggcaaatccccyttattaattccaaaaaaataaaccsaaaawgggtttgaattttttktttccccayttttggaaacaaawtyccccctttttaaaaaagttggaacccccamccytccaaaggggaaaaaacsyttttytggggggnaanggggcccccntactttnaacayccccccccaawcaatttttttggggggtcccnaaaggtccccctaaaancttttttcggaacccnaagggganccccccatttaaaattttnggtn

SEQ ID NO: 197 - DNA, 582 bp, Homo sapiens
ggcacgaggtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaatccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaatatactgtttatctgtttctgaaaaaaaaaaaaaaaaa

SEQ ID NO: 198 - DNA, 1020 bp, Homo sapiens
  SITE (86): n equals a,t,g, or c
  SITE (87): n equals a,t,g, or c
  SITE (107): n equals a,t,g, or c
  SITE (978): n equals a,t,g, or c
  SITE (990): n equals a,t,g, or c
  SITE (995): n equals a,t,g, or c
ggtgtgcctggatggtcgtgtaggtgagttttaccaaggattatggtaacaaatgagtgagacctctatggagaaaatattgaagnncattaaagaagacctcatantaggagagaatgtsctttggaggatttgtattgagcttttacagtattcatttttcaactcaaggcaatggctttctacaccaactctaatccataaacgggtcttatgacatctatgaagtagtagcaagacatgcttagtgtgtatttctctctttgagacactgtaatttctaccagaaatttccagagcattatgtaggtagaaaaaaatgcaagcaagctgttaaagatcttggatcccattatatagtatgtatagctgaaatctgtaattcaatcactttttctcttttatcctctaaccaaaaaattgtttaattttgcatcccaaatgtttttaatctttgtatattttttaaaaayccttttctcctcatcattgccttttttgtggttgtaaatagacttacttgcactttgaagatgagttactccttgtcatcttacaaatatgtgatatggtaattttcataacagatgtcagttttgaaccaagaattggtgatttgtttataagaaaaaaactggcttcatttctgtgaaattgctctttgaaaatttctttttacacgtgtaagccaactgagataccgtgatggtgttgatttctttcaatgatgcttaccatctattttagccactgagccttttattatttgtctatttgtaaagtttatttgtcttaactcatttaataaatatactgtttatctgtttctgaatggggactgaactttttggatattgatattgatttgaaaatattttggaattttttctacttgaaattttagaaatctaatkgaaaattctataatgtactgaaagtawggttgtgtacagtgakcactctctaataatatgatgncttgccctaaangaggngggacatgtcccactttccaccacg

SEQ ID NO: 199 - DNA, 524 bp, Homo sapiens
  SITE (28): n equals a,t,g, or c
  SITE (75): n equals a,t,g, or c
aattcccgaagctgagggttgtgtgccntcgggcgagccaagtcttttgaccggacccttcccggcgcagaaganctgaagttgatttgagagcctgtktttggggttragccgagctgctgcgggcttygtcgccggccaggacacaagytacttgcaacggggcggcgcctggcttatgatgttcctcaacccaggggcggcctctgccctctactcgtgccaggcccacttgccaggcaggagccctccccaagccttcagggctgctcggagtcacctgttggaatggactaaaaggacccttgtgtgggaacaggtgctccaaacaccctgctgctggctgccaggcaggccctctggaagggaaggggcaggactcatcaggacctccctggaccctgcagggcaggcagttggcccgagcccaagcatttggctctgcttgccccaaggggacaggaagcctcttgggcctcttcccttcctggacaaggccccctgcctttgcctcacataaactg

SEQ ID NO: 200 - DNA, 332 bp, Homo sapiens
gtgatacaaggaagggtgatcatcatctgtcaccatgcaattcctgctcacagcctttctgttggtgccacttctggctctttgtgatgtccccatatccctaggcttctccccctcctagaagggcttcttgatagattagaaaataagaatgagtgacatttcctatgtgcatataagaaggagccacaagacatgtcttttaaataaaaggacagtgtccatccttttagctgccgaatagaaccttggtctcatcctcctggagctaggscttaaaacagcttctgtgtttctsattkgtctcartgttttgccaaggttttattcgg

SEQ ID NO: 201 - DNA, 376 bp, Homo sapiens
ccagggaagccccargcctgtcctgaattgacatcagtgcttccctgaactgcctcccccacccctgggcattatcccaggaaacttatgttttctagaagctaagcagctgctgggactcagggactggtgcaggtaggctgagtggcagctcagtcctagaaggtctctgaagatctggactgaggaccytgctactccccaagccagagcccatcagccaggcctgctgtgagccacctgcctgtggagtgctgagctcaaccaaaggctggcaagctctgggcctcatttaagggattctgatgagccgatgggccctggaggcagcccattaaagcatctggctcgtttttggaaaaaaaaaaaaaaaaag

SEQ ID NO: 202 - DNA, 741 bp, Homo sapiens
  SITE (361): n equals a,t,g, or c
tcttgaagagtgtacagtacaggattattataatgaaagtttatatcaacagggtttcgttggctctgcatatattataagcaaaagagattggtaaagtgccacagtattccagataacttttcagttgcggcctttcttctcgttctttaatttgaaacctagatacatgcagtaaaaactaggagaatgacttttacccttggggacagccaagttttgttgataaacctatttcctagcatgccttcaggaagttgtgccagaccctagattgtgaaggacccactgttcttctgttgtacgagctccctgaaccattgttcagaggaccaatgtcacatcgcttcatgggcatggnccatgggagcatctgggtgatayctgtctacagtattggctcttctgcgaggctgatacacaaggcctctcttccacatgatcatttgcaaacctcccccagcccctaccatccaatgtggaaggaaaacaagaactgcctgaagaagagtccaagctacagatacacagcgtgtgcattgcggctgtcaccttcctcctcccacttctgtatcctcagagatgctgcgtggatgtttccttaacctcagctgacttccctgtgaatgtctaatgctagttcagggcctccaggcattgatttgtacagtggtaactcccaatgaggcttctgttatcatttggtgtgctttytctgtcattaaaagaaatgattttccc

SEQ ID NO: 203 - DNA, 1192 bp, Homo sapiens
  SITE (93): n equals a,t,g, or c
cccagtatatttctataacatttattttagtgaacttataatgtttctttgtattaaattattagattatatctttagataatattgttactnaattagtaggtaatatatattttattcaaaaataaattgtgcatctaatgtctaccaattaatgtacttgtagatgtatcttatcttaacttgagtctttgctgcccctaatgaggtgtgaaggactcttctcccctggggaagtttttctttttcaggagggaggagggctttcccaggtaatgtgtctagagtgttgggcagaaraatctgggaccacaccacaccagttctctccttaatccacgtcatttgccttctatcccagctatgtttccagtgtcctctgggtgtttccaagagcaacaagaaaygaataaatctctgktgagttgtttatttgttcttcactttgttttacactgtawtttctgagtttatgggtgtctgtgaattaaaaaggaaaagtrgaaataagtaaaactcaggttgaaggaaatatacataaataagataaagctgacctgtagatatarrcaggttataaragcttagagttgtctaagttgrgtgcaaaktttcctctgatctttctgatgccgaracaaaaaaggcagtcatgtttgtwatgtgattggaatggaacccgaraagagagcaygctgtgttcttggggacaggaaagcttgygtgcaccaagtctkaaccaccaccttcatgggacatagrttatgtgctggaacatatttcacaccggcctggcagtaaacacttgtagtgttgtgcagtggaaacggtcatcttccgctaaagcacggcgtgttgtgcagcggaaatggtcatctgctgctaaaacacagcttccatcgtaatgtatgctccttactcaaagagtgtggtcccaaacagcctttgggaggtcctccttgattcatggatgaaacctggaacatcttgaggactgagttaaccataggtccttaaataactctccacacgtttttcttagtttatctctacatgcagggtgtgcagcagcctgttcaaagtcatattttctgggaaatatttccagtgtttatttgcactttagcccactctgtgtagccttatttcttctaaactcaccattaatctgaataatagtcaaatttagggg

SEQ ID NO: 204 - DNA, 589 bp, Homo sapiens
atcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccmgggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtccca

SEQ ID NO: 205 - DNA, 847 bp, Homo sapiens
ggcacgagcgcaagctgctggccgccatcaacgcgttccgccaggtgcggctgaaacaccggaagctccgggaacaagtgaactccatggtggacatctccaagatgcacatgatcctgtatgacctgcagcagaatctgagcagctcacaccgggccctggagaaacagattgacacgctggcggggaagctggatgccctgactgagctgcttagcactgccctggggccgagcagcttccagaacccagccagcagtccaagtagctggacccacgaggaggaaccaggctactttccccagtactgagtggtggacatcgtctctgccactcctgaccagcctgaacaaagcacctcaagtgcaaggaccaaagggggcctggcttggatgggttggcttgctgatggctgctggaggggacgctggctaaagtggggaggccttggcccacctgaggccccaggtgggaacatggtcacccccactctgcataccctcatcaaaaacactctcactatgctgctatggacgacctccagctctcagttacaagtgcaggcgactggaggcaggactcttgggtccctgggaaagagggtactaggggcccggatccaggattctgggaggcttcagttaccgctggccgagctgaagaactgggtatgaggctggggcggggctggaggtggcgccccctggtgggacaacaaagaggacaccatttttccagagctgcagagagcacctggtggggaggaagaagtgtaactcaccagcctctgctcttatctttgtaataaatgttaaagccagaaaaaaaaaaaaaaaaaaaaaaaaaa

SEQ ID NO: 206 - DNA, 852 bp, Homo sapiens
  SITE (53): n equals a,t,g, or c
  SITE (55): n equals a,t,g, or c
  SITE (318): n equals a,t,g, or c
  SITE (363): n equals a,t,g, or c
  SITE (380): n equals a,t,g, or c
  SITE (383): n equals a,t,g, or c
acaaacatactcgcaggaaggagtctcatgctgcccgcagcatcagcgcaacncntggccgccatcaacgcgttccgccaggtgcggctgaaacaccggaagctccgggaacaagtgaactccatggtggacatctccaagatgcacatgatcctgtatgacctgcagcagaatctgagcagctcacaccgggccctggagaaacagattgacacgctggcggggaagctggatgccctgactgagctgcttagcactgccctggggccgaggcagcttccagaacccagccagcagtccaagtagctggacccacgnaggaggaaccaggctactttccccagtactgaggtggtggacatncgtctcttgccactccntgnacccagccctgaacaaagcacctcaagtgcaaggaccaaagggggccctggcttggagtgggttggcttgctgatggctgctggaggggacgctggctaaagtgggkaggccttggcccacctgaggccccaggtgggaacatggtcacccccactctgcataccctcatcaaaaacactctcactatgctgctatggacgacctccagctctcagttacaagtgcaggcgactggaggcaggactcctgggtccctgggaaagagggtactaggggcccggatccaggattctgggaggcttcagttaccgctggccgagctgaagaactgggtatgaggctggggcggggcyggaggtggcgccccctggtgggacaacaaagaggacaccatttttccagagctgcagagagcacctggtggggaggaagaagtgtaactcaccagcctctgctcttatctttgta

SEQ ID NO: 207 - DNA, 1354 bp, Homo sapiens
  SITE (465): n equals a,t,g, or c
  SITE (794): n equals a,t,g, or c
  SITE (1344): n equals a,t,g, or c
  SITE (1349): n equals a,t,g, or c
  SITE (1350): n equals a,t,g, or c
  SITE (1352): n equals a,t,g, or c
  SITE (1354): n equals a,t,g, or c
gattcggcacgaggcttgctggagcaggagaagtctctrgccggctgggcactggtgctggcasgarctggcattggactcatggtgctgcatgcagagatgctgtggttcggggggtgctcggctgtcaatgccactgggcacctttcagacacactttggctgatccccatcacattcctgaccatcggctatggtgacgtggtgccgggcaccatgtggggcaagatcgtytgcctgtgcactggagtcatgggtgtctgctgcacagccctgctggtggccgtggtggcccggaagctggagtttaacaaggcagagaagcacgtgcacaacttcatgatggatatccagtataccaaagagatgaaggagtccgctgcccgagtgctacaagaagcctggatgttctacaaacatactcgcaggaaggagtctcatgctgcccgcaggcatcagcgcaanctgctggccgccatcaacgcgttccgccaggtgcggctgaaacaccggaagctccgggaacaagtgaactccatggtggacatctccaagatgcacatgatcctgtatgacctgcagcagaatctgagcagctcacaccgggccctggagaaacagattgacacgctggcggggaagctggatgccctgactgagctgcttagcactgccctggggccgaggcagcttccagaacccagccagcagtccaagtagctggacccacgaggaggaaccaggctactttccccagtactgaggtggtggacatcgtctctgccactcctgancccagccctgaacaaagcacctcaagtgcaaggaccaaagggggccctggcttggagtgggttggcttgctgatggctgctggaggggacgctggctaaagtgggkaggccttggcccacctgaggccccaggtgggaacatggtcacccccactctgcataccctcatcaaaaacactctcactatgctgctatggacgacctccagctctcagttacaagtgcaggcgactggaggcaggactcytgggtccctgggaaagagggyactaggggcccggatccaggattctgggaggcttcagttaccgctggccgagctgaagaactgggtatgaggctggggcggggctggaggtggcgccccctggtgggacaacaaagaggacaccatttttccagagctgcagagagcacctggtggggaggaagaagtgtaactcaccagcctctgctcttatctttgtaataaatgttaaagccagaaaaaaataaaaaaaaaaaaaaaaaaactcgaggggggcccagacccaatctccctatagtaagncgccnnanan

SEQ ID NO: 208 - DNA, 1378 bp, Homo sapiens
  SITE (72): n equals a,t,g, or c
  SITE (402): n equals a,t,g, or c
  SITE (1371): n equals a,t,g, or c
  SITE (1376): n equals a,t,g, or c
tccccaggtgcacagccagggccctcctgtctgcaggagaattcacagctggtgtgggactcagcccctagnccattcaaagccttaatgttgtaatcatatcttacgtgttgaagacctgactggagaaacaaaatgtgcaataacgygaattttatcttagagatctgtgcagcctatttctgtcacaaaagttatattgtctaataagagaagtcttaatggcctctgtgaataatgtaactccagttacacggtgacttttaatagcatacagtgatttgatgaaaggacgtcaaacaatgtggcgatgtcgtggaaagttatctttcccgctctttgctgtggtcattgtgtcttgcagaaaggatggccctgatgcagcagcagcgccagctgtanataaaaaataattcacactatcagactagcaaggcactagaactggaaaagaccacagaaaacaaagaatccaaccctttcatcttacaggtgaacaaactgtgatgatgcacatgtatgtgttttgtaagctgtgagcaccgtaacaaaatgtaaatttgccattattaggaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgattttattgcagttgaaaaaaaaaaaaagctattccaaagatttcaagctgttctgagacatcttctgatggctttacttcctgagaggcaatgtttttactttatgcataattcattgttgccaaggaataaagtgaagaaacagcaccttttaatatataggtctctctggaagagacctaaattagaaagagaaaactgtgacaattttcatattctcattcttaaaaaacactaatcttaactaacaaaagttcttttgagaataagttacacacaatggccacagcagtttgtctttaatagtatagtgcctatactcatgtaatcggttactcactactgcctttaaaaaaaaaaaccagcatatttattgaaaacatgagacaggattatagtgccttaaccgatatattttgtgacttaaaaaatacatttaaaactgctcttctgctctagtaccatgcttagtgcaaatgattatttctatgtacaactgatgcttgttcttattttaataaatttatcagagtgaaaaaaaaaaaaaaaaaaaaaaaaaaaaaaaaaaaaaaaaaaaaaaaaaaaaaaaaaaaaaaaaaaaaaaaaagaanaaaanaa

SEQ ID NO: 209 - DNA, 1166 bp, Homo sapiens
  SITE (3): n equals a,t,g, or c
  SITE (12): n equals a,t,g, or c
  SITE (79): n equals a,t,g, or c
  SITE (650): n equals a,t,g, or c
  SITE (1154): n equals a,t,g, or c
aanccactgcantttaaaccccctcccctccaagaaagttcacaaccggccatggatgaccctcattttagatgggccncaatatttaagatggactgrggmccccaragactgacccttgaaagggggactcagaagaaagatccttgacattgccmaacatgctgggcttgtccaacacagtgatgcggctcatcgagaarcgggctttccmaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagagggggcccagaggccgccttttgaaatgtttgcctgtctgaactgtgaagacacttgggagtgattgtggtctaatttccaacctgctctgttttctgtgacatcttggagggggagctagtgccamcaccatgcgcggtgcttaggaaatgaaagaagtcccgggtctgtctctctcactctcgctctcamtgggggagggaaagaatggctttggtggctttgttcacacagctgatgcgtgscctgggaaggtgtccacagtgagccctgtgtgcaggactgtccacnacggttcacaccttgtcaccatcaggcctttctggctcctgatagggtggagcaaaagtggaaaggaaaggaaagaggcyttttctcacagccattatattaaatagtaggtcgattcacatcytcgtgctcctggccaccctcccctgtgcctcagtgacatgtagatgactgactgccaatacttgtcaccattccctggaagcagctacctaggggaaacaagatgtagtgctattgccgataacaagtaagattttccacactacagctgggtgtttctcttttctaaagtgaggccagtgttatttcccgggagtgttcagtcttgaccctagtcactgattttttctagttgttaatagagtggttgggcttttaaggttcagagactgtgggcttgggcacctgcgcccagggsttttgtgggggcctttgccccttagraaagtagcttttaggggcaaagatttgttgattttccccattacagtcttcagctcnagggttttaaaa

SEQ ID NO: 210 - DNA, 697 bp, Homo sapiens
  SITE (459): n equals a,t,g, or c
tacttctaggattataaggaattaacattgagatgacatttccatttgagaaggaaaatagttgctttcagtgccttttatttgattcctggagagagcagactcgcacsaacattcaaccccagcgctgatatgacagtaatcctcagaggcagagcccagcacaaaacagcaatgctagaaagttacaattggaaagtttcctgccagcttcgggaatgacactgcaaagctgatgccagaaactgccagrgtaattctcctcattactgctctacccacccactttcagctccccaaattaactagtgcagttgactaattctctttacctttatcatttarggtgargcattgcacaaaaactctcgactttgccatataagggctgtggttctctgtggtcccctggataagaggcatcaccattatctggaaacatgcagtaaatgcagattnttcatcttctccccagacctcctgagttagaaattcacaagttctccaggtgatctcatacatgctaaagtttgagaaccattgagtaaagttaatgcattaagaagagattagatagggatggtggcgtatcttcctacagtttccctgttaacaagaaagtcagaggtcagttgatcagacattagattatttattgctaaaactaaaaaaaattaaaaaaaactggaggggggcc

SEQ ID NO: 211 - DNA, 932 bp, Homo sapiens
cgtgagtcacctctctatagtgggcgtggccgaggccggggtgaccctgccgaagcctccgctgccagaaaccatgttcaaggtaattaaaaggtccgtggggccagccagcctgagcttgctcaccttcaaagtctatgcagcaccaaaaaaggactcacctcccaaaaattccgtgaaggttgatgagctttcactctactcagttcctgagggtcaatcgaagtatgtggaggaggcaaggagccagcttgaagaaagcatctcacagctccgacactattgcgagccatacacaacctggtgtcaggaaacgtactcccaaactaagcccaagatgcaaagtttggttcaatgggggttagacagctatgactatctccaaaatgcacctcctggattttttccgagacttggtgttattggttttgctggccttattggactccttttggctagaggttcaaaaataaagaagctagtgtatccgcctggtttcatgggattagctgcctccctctattatccacaacaagccatcgtgtttgcccaggtcagtggggagagattatatgactggggtttacgaggatatatagtcatagaagatttgtggaaggagaactttcaaaagccaggaaatgtgaagaattcacctggaactaagtagaaaactycatgytctgccatcttaatcagttatrggtaaacattggaaactccatagaataaatcagtatttctacagaaaaatggcatagaagtcagtattgaatgtattaaattggctttcttcttcaggaaaaactagaccagacctctgttatcttctgtgaaatcatcctacaagcaaactaacctggaatcccttcacctagagataatgtacaagccttagaactcctcattctcatgttgctatttatgtacct

SEQ ID NO: 212 - DNA, 661 bp, Homo sapiens
gtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgagatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttc

SEQ ID NO: 213 - DNA, 592 bp, Homo sapiens
  SITE (394): n equals a,t,g, or c
  SITE (545): n equals a,t,g, or c
  SITE (566): n equals a,t,g, or c
gaaactgacattgttaaacacactaaaacagaagtacttacctcttgaagatttaatatataatggttgacatgatacatgtacatgaatggaatgaccagatgcttatggtctacattttcctttatcctgttagtattaccttccttaatctttgttccttaacatgctaaattcctcttcagtgtttattttctagtgacagaatgctaacatttcttacaccctggcagaagggagagaaatgtgttttggggtgggtaactaaatttttgagtgaaatatcataagatgagaatggaaagagggagacacaaagagttataacaaaaaaacaatggtttttttagccatttgactggctctttaaatagtctacaagacattcacgttnaacatcacttttagtgaaataaaatgtgccatactagtatgtgcttcaaaagggcaaatgtgctttagtgccctaaggctaaattttggtcatttgacatcagagatgttgtaagtattgcacttaatacgcacctatttctcaatagtgntatttttttggctagcatttnctttaccactaaccttgttggatagc

SEQ ID NO: 214 - DNA, 938 bp, Homo sapiens
  SITE (100): n equals a,t,g, or c
tggagtggctttccagctgaatgaatcctatgtctcgcgtgcaggtggttggttttcaatgttcttsctaatttttttcctattggctcttgggagtttnctttgtttgctcctgtgtttgcccagctttaataaaaccaggcgcaaacaaaaaccatagcattctgaaacaatagggggcccacattggacccagtatgtcactttaatggacttcaagaaaaaatctgaatgggaaaatgacactaggaatgtatactccacacattttatgccatataatggtgtgttttcttaattttgtttcttgtggcgaaatgtggctttcaaattaaaatgmccttttcttcttkgaaactttttgtttkgactkgtataattaagggtttggaaagattcataattmtgagagaggtttgcaaccaggagatacaaagaagtctcagtagtaatcttgttcatgtgcttttacagccagctacatttaagratgtattagttacagaaattatatgtctgtgtatgtgtctctactcaataaagtacatgcctccacataatgcggtgctgtccatctcggcaaatactggccaagtccctttatgacaggcacacagaaaccatagcatggtctggctttcagaaaatgcctctcatctttcctggaaccttattttgctaaatgtctgttttcttgtgatttgttgtacctcacagcaccattgtgaccatggtgatgcctcatttgcatgatatgtaccttgtgtttaatgtgaaatacattttcattgaagagtctgatgacttgctagcgttttattttttctgtaagctcaatgtgctgaaaccaaaccaggcttttaaaaacctgtgtagaagaaaaccaaaaaatcctgtgtgggtgtcctttccctgtcaaactcattaaaaattccttt

SEQ ID NO: 215 - DNA, 1079 bp, Homo sapiens
agcctgccgggagagtggtggcatctraraggctggtcgtggactgtggttgggggaggtgggagctgttttaaccgtgtgccccctctcctgtgcckgcgtgggcatcccccggggcagtggaacgcgggcgctcctccagcttccgagtccagccagcctgggcgcggggcgcgcccccgagacacccgaggagtccgttcctccctggttacgtggactgtggagctggtctcttgtggctcagcgccgtgcggaggttgaagcgtacctgcggaggtcgcaccaggggcgtgaggaggaggaggaagggcatgagccgagcttgaggaatccgtgytccaaactctacactcaaggrtgcmctgcgcaactctggtggcgatgggctggggcagatgtccttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgtgtttgacacaggcttgcgggacgtgcagccctacctgtacaagatctccttccagatcactgatgccctgggcacctcagtcaccaccaccatgcgcaggctcatcaaagacacccttgccctctgagcgtcgctggatctctgggagctccttgatggctcccagaccttggcttttgggaattgcacttttgggcctttgggctctggaacctgctctgggtcattggtgagacttggaaggggcagcccccgctggcttcttggttttgtggttgccagcctcaggtcatccttttaatctttgctgacggttcagtcctgcctctactgtctctccatagccctggtggggtcccccttctttctccactgtacagaagagccaccactgggatggggaataaagttgagaacatgagtttgggctgaaaaaaaaaaa

SEQ ID NO: 216 - DNA, 3791 bp, Homo sapiens
  SITE (3671): n equals a,t,g, or c
  SITE (3682): n equals a,t,g, or c
  SITE (3771): n equals a,t,g, or c
  SITE (3779): n equals a,t,g, or c
tgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcatcagggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgctttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcacttcttaaaagtcataaaaacaatcaaataggrtcatgtttattgtcatgtgtttcctggkttctgacctgtgtgcacacccctgtgtgtttataatttttaaattgaattttatatggggtttttatttgctaaaaaccaggctgttgaatcacatttgggaagggtacttatcttaatgactaatgacttaattgggaaagttgaattcttgtaaaatacaaaatccaaggacttcttgggatttaatctaattgtcacttcnttaggcagatncacttttttggataatggaaagttaagcataccgaatgctacttttggttgacaaacgggcctaatagtccggggggaaatccctaacnggtaaggntcccaagtatgg

SEQ ID NO: 217 - DNA, 1334 bp, Homo sapiens
  SITE (199): n equals a,t,g, or c
  SITE (1265): n equals a,t,g, or c
  SITE (1267): n equals a,t,g, or c
cagtgctcgctcctgctcggggcgctgcggccccgggcgtcgccatgaccagtgagctggacatcttcgtggggaacagacccttatcgacgaggacgtgtatcgcctctggctcgatggttactcggtgaccgacgcggtggccctgcgggtgcgctcgggaatcctggagcagactggcgccacggcagcggtgctncagagcgacaccatggaccattaccgcaccttccacatgctcgagcggctgctgcatgcgccgcccaagctactgcaccagytcatcttccagattccgccctcccggcaggcactactcatcgagaggtactatgcctttratgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcgactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggcctctgggaccgctacatgggcaccctccgcggctgcctcctgcgcctgtatcatgactgaggtgcctcccaacgctccgcccacgctgacaataaagttgctctgagtttggagactggtcctcgctccggggagcaagtggggggcgtgcagatgtgcctgtgtctgtctctgagcacctggtgtccgtgtacaaggatggatgtgtncngtggctccttgggaactgagacatatctcagggaatggtgtctgtgctcagcccatccaccagaaga

SEQ ID NO: 218 - DNA, 1511 bp, Homo sapiens
gtggcggggatgctgcgagggggtctcctgccccaggcgggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaagrtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagcactgctttataataaaatgaaata

SEQ ID NO: 219 - DNA, 642 bp, Homo sapiens
  SITE (633): n equals a,t,g, or c
aggccttacttttcctcccacaaaggagtcgcagccacgctagctctgacttgccactgtgacaaagttcacgtagcaggtctaggcaaagactgggcaattgagcagaggagacggacctgtgagtctgaccrygagscggrccccttcaccttggctgggctggtcctggtccttaggttttgtcaggttgtccttgtttggatccctcaactaggtgataagcactggagggggatgacccgccttggacgtgtttctttaacctcatccatataatagggccgtgggatggttgtagaggtaaagcaggatgatggtgttttaagaccagagcttgggaccagggctcctacacctaattttctctcctggtagctgaacaaaggtctaaattagcttaacaaaagaacaggctgccgtcagccagagttctgaaggccatgctttcagtttcccttgttgacaattgctctccagttcctatgaaagcacagagccttagggggcctggccacagaacacaaccatcttaggcctgagctgtgaacagcagggggttgtgtgtctgttctgtttctctgcttgccgaactttctcaataaaccctatttcttattttatatttacgtnggtgctggg

SEQ ID NO: 220 - DNA, 1241 bp, Homo sapiens
ggtcccactgttccattttatgctaatagattccattctagggcccagccgtctcttgactgatggtgttccctttaacccttggcatgtataatagaattttggtgaatgaaagaacccaaataggccagatagtccccccaggccctgatatccataaaaggcttgggaatgcattatgtaattgtccttagtctttttgttgttttagaaaaaaaaaacaagatgggctcagatggatgcctacgtaaaaatggttcctagctgtgtactcataacttttctttgaattgagtagtgaaaggaaggaggaggaaaggaaattaaatgtccttctagtattctctggactcaagtctgacatatgrgataataacctatattgaaatgccaagaattgtatctgaaacaagrgaacagtttgacacatttatcatgccttcatattacatattaactgaaaccaattaataaacatatgaaatatccattgcacaaggcaaaggcacctaaaccttttgtttctttttctacatagcagaaattgattttttttttatttttttaggggaacctatataattatgacccagtgatgtcttttggtgacttaagcttatgaattcaggttacaattgagttgattctagatggttactaccttgaaaaggatgttggtgccttatgtgacacgagccagagcctgctgggaataaacaaagcagattcatgccaacaccaactcgtagctttagtggcagatgggagtggtcacagactcccaaaatgtggggctttggatttccacaccatcccacgtgtgtgtcatcttcctctttcacactcttgatgataatttgaaaatgrtgaaatcacctctgaatttgcctatagcatgagcacattcttatgacaacataacaaatagttcataatgtgaatattagaaactgttacagcctgcagttaccataattttccatgtttgtggaattgatattgaaatagcagggctaaggaattactggcaagttttagcctgtgggtaataccttagggttatttaaatatttgtaattttatttaaatgttcatgaatgtttgaaaggaacaaaattatcagggatggctctttgccatgggtcttattttcaccctcttttctgtaagaaaaaagaacaatgtcttaatgtatttttaaagtttttggtatagtttctaattccaattttaataaaagt

SEQ ID NO: 221 - DNA, 504 bp, Homo sapiens
  SITE (35): n equals a,t,g, or c
  SITE (47): n equals a,t,g, or c
  SITE (56): n equals a,t,g, or c
  SITE (489): n equals a,t,g, or c
cggattttctaggaccccaaaaaaaaaaaaagggnaaaaaaaacccncaaaaccanccaaaaccccaaaaaaaaaaaaaatccacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaaaaaaaaaaaaaaaaaaactnggggggggccccgaa

SEQ ID NO: 222 - DNA, 1080 bp, Homo sapiens
  SITE (1026): n equals a,t,g, or c
  SITE (1050): n equals a,t,g, or c
tgtttatgtgacctaaaacatacacacatgcacacacacatacatatccattcattcattcattcaagtggtgtttccagtgtctgtgtgtcactgtttatgcagtttccatttcccagtgaattatgagtggagggcaacttttctaaccagattgtcttttcagaacaaagacckgggrattgaggaagagtttggaaagagggagaggcaaggaaagagagctttaaattgaaaggttaatttcctaagaggaacctgggctgaatgactacagtgttataccctccaatctttgcaggtgggcatggaacactgcttgtatcactctgtgcacggtataaatccatatatccacaaaaacacacatccatccatcaacatatacatggtttgggatgagcaggtcaatagttttgagagggagtttgttcctttttttttctcattatactcttaaattgttgtcagttatcaaacaaacaaacagaaaaattgtttgggaaaaaccttgcatacgccttttctatcmagtgctttaaaatatagactaaatacacacatcctgccagttttttcttacagtgacagtatccttacctgccatttaatattagcctcgtatttttctcacgtatatttacctgtgacttgtatttgttatttaaacaggaaaaaaaacattcaaaaaaagaaaaattaactgtagcgcttcattatactattatattattattattattgtgacattttggaatactgtgaagttttatctcttgcatatactttatacggaagtattacgccttaaaaatacgaaaataaattttacaaggtttctgttttgtgtggaagagtaattgatgttgctaagaatgatgtttgtttttttggggtttttgttgttttttttttaaatgttaccagcactttttttgtaagtttcactttccgaggtattgtacaagttcacactgtttgtgaagtttgaatatgaaggaataattaaaaaaaaaaaaaaaaccncggggggggcccggtcccattggncccaagggggcggttacggggtcacggccg

SEQ ID NO: 223 - DNA, 1258 bp, Homo sapiens
  SITE (1226): n equals a,t,g, or c
tgaattgagggcttaaagataaacatatgggrttggagttgtgtgtccatagggtttcactgcctatttgatttgagtttatccctattaattttttacagtgaaattttattaaagtataatgtacatatattttcagtggattttgctctgaaggttctccagtggtctgactacgagatagtgcggcttcagctgtgggatattgcagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggascagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggyttattttccatcccagttctgggaggtcttttaagtctcttccctttggttgcccacctgacmattttattaagtacatttgaattgtctcctgactactgtccagtaaggaggcccattgtcacttagaaaagacacctggaacccakgtgcatttctgcatctcctggattagcctttsacatgttgctgrctcacattagtgccagttagtgccttcggtgtaagatcttctcatcagccctcaatttgtgatccggaattttgtgagaaggatkagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggaggggtctgggcatctgtggatttttggctactagaagtgtcccagaagtcactgtatttttgaaacttctaacgtcataattaagtttctcttgtcttgggcatcaagantagttccaattttttgggccggggcagggtgg

SEQ ID NO: 224 - DNA, 1693 bp, Homo sapiens
cacaatatatgaaatagtaccctctaaaaaagagaaaaaaaaaatcaggcggtcaaacttagagcaacattgtcttattaaagcatagtttatttcactagaaaaaatttaatatcaaggactattacatacttcattactaggaagttctttttaaaatgacacttaaaacaatcactgaaaacttgatccacatcacaccctgtttattttccttaaacatcttggaagcctaagcttctgagaatcatgtggcaagtgtgatgggcagtaaaataccagagaagatgtttagtagcaattaaaggctgtttgcacctttaaggaccagctgggctgtagtgattcctggggccagagtggcattatgtttttacaaaataatgacatatgtcacatgtttgcatgtttgtttgcttgttgaatttttgaacagccagttgaccaatcatagaaagtattactttctttcatatggtttttggttcactggcttaagaggtttctcagaatatctatggccacagcagcataccagtttccatcctaataggaatgaaattaattttgtatctactgataacagaatctgggtcacatgaaaaaaaatcattttatccgtcttttaagtatatgtttaaaataataatttatgtgtctgcatattgcagaacagctctgagagcaacagtttcccattaactctttctgaccaatagtgctggcaccgttgcttcctctttgggaagaggaaagggtgtgtgaacatggctaacaatcttcaaatacccaaattgtgatagcataaataaagtatttattttatgcctcagtatattattatttaattttttaggtaatgcctatctcttggtctattaaggaaagaagcaatcagtagagaattcaggatagttttgtttaaattcttgcagattacatgtttttacagtggcctgctattgaggaaaggtattcttcyatacaacttgttttaacctttgagaacattgacagaaattatgcaatggtttgttgagatacggacttgatggtgctgtttaatcagtttgcttccaaagtggcctactcaagaggccctaagactggtagaaattaaaaggatttcaaaaactttctattcctttcttaaacctaccagcaaactaggattgtgatagcaatgaatggtatgatgaagaaagtttgaccaaatttgtttttttgttgttgttgttgttttgaatttgaaatcattcttattccctttaagaatgtttatgtatgagtgtgaagatgctagcgaacctatgctcagatattcatcgtaagtctcccttcacctgttacagagtttcagatcggtcactgatagtatgtatttctttagtaagaatgtgttaaaattacaatgatcttttaaaaagatgatgcagttctgtatttattgtgctgtgtctggtcctaagtggagccaattaaacaagtttcatatgtatttttccagtgttgaatctcacacactgtactttgaaaatttccttccatcctgaataacgaatagaagaggccatatatattgcctccttatccttgagatttcactacctttatgttaaaagttgtgtataattgttaaaatctgtgaaagaataaaaagtggatttaaattaaaaaaaaaaaaaaaaaaaaa

SEQ ID NO: 225 - DNA, 1196 bp, Homo sapiens
  SITE (30): n equals a,t,g, or c
acgcgtgggtcgacccacgcgtccgcgacntggcgtggtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaata

SEQ ID NO: 226 - DNA, 1791 bp, Homo sapiens
tcagggaggtggcaggaaaggcttggaacagctgccggagtgacggagcggcggccccgcccggttgcgctggaggtcgaagcttccaggtagcggcccgcagagcctgacccaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggtcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtraggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccasccagcaagaaagcctcaaagggcaaggggctccgagggagcgccaagatttggtccaagtcgaattgaaagractgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagkcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataatatgacgcagaaataaatct

SEQ ID NO: 227 - DNA, 2517 bp, Homo sapiens
acactagtggatccaaagaattcggcacagcggcacagcattgttgagcttttctgtgtgtgtggggccctcaagcgagctcgactggtccatcctggggtagcgasgtggtgtttgtgaaaaaggacgatgccatcaccgcatayaagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctktgaccacgcagcccacagawttcaaaatcaagctttgagcaggggagtraggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttmagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccrcccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattcctaaaaaaaaaaaaaaaaaactcgagggggg

SEQ ID NO: 228 - DNA, 2424 bp, Homo sapiens
  SITE (6): n equals a,t,g, or c
  SITE (2366): n equals a,t,g, or c
ttgtanctaatcgaggattgattctaatgacagagtctttcaacactttgcacatgatgtatcacgaagctacagcttgccatgtgactggagatttagtagaacttctgtcaatatttctttcggttttgaagtctacacgcccttatcttcagagaaaagatgtgaaacaagcattaatccagtggcaggagcgaattgaatttgcccataaactgttaactcttcttaattcctatagtcctccagaacttagaaatgcctgtatagatgtcctcaaggaacttgtacttttgagtccccatgattttyttcatactctggttccctttctacaacacaaccattgtacttaccatcacagtaatataccaatgtctcttggaccttatttcccttgtcragaaaatatcaagctaataggagggaaaagcaatattcggcctccgcgccctgaactcaatatgtgcctcttgcccacaatggtggaaaccagtaagggcaaagatgacgtttatgatcgtatgctgctagactacttcttttcttatcatcagttcatccatctattatgccgagttgcaatcaactgtgaaaaatttactgaaacattagttaagctgagtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagccgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaagggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgctattctgtgcactnaattaaactgattgtgatgacttaaaaaaaaaaaaaaaaaaaaaaaaaaaaaaaaaaa

SEQ ID NO: 229 - DNA, 1080 bp, Homo sapiens
atataggacggataatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacaggggtggcaaaatatgcctgacggatcatttcaaacctttgtgggccaggaatgtgcccaaatttggactagctcatctcatggctctggggctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtttctaaggctgcacagggaagggaaagactgggctttggacaatctagaggtaatttatatccgcccccaggtggagcaacatgcgattctggaggcacgggggtaactgaaagtgagtacatatagtctttctggtttctggagataacccatcaataaaagctgcttcctctgggtaaaaaaaag

SEQ ID NO: 230 - DNA, 1336 bp, Homo sapiens
  SITE (603): n equals a,t,g, or c
ttgcattcacaattactgggaggcaggcaggggcagttgcatgctgggggtggctgcatggsctgccasctctcctgggtttgaaggatgcggtacasctgcttcagctgagcaacgatgttatccttgatgtctggggttgagatctgcaggcggacactgccactatcaaaggatcgtgtgaaatcaccagaaaacatctcgtagatcatccgagccactactggaatgacctgaaccaagatgagtttcctttccaatggtttcccatctggccattcttccccaaagcataagtagatctcaaacggtggctgcttctctatctgtcctttctggtgggcaatgagatcgctaaggaatgtttccagacaaaatagcttgaccttcttttgtctctcaatcaggttgggagcaacaagtgatggggcacatggcccagaccagtacaccttgcactggcacagyctgatggcataaatggcatgaccgctgacctccaggatcagtcctctgtccatgacgtccagcagcttgctagtgaacagcttctgcttctcattggtaatatgctcaggacctgggaatttgacctgctccagnctgacgggaccaaagagctcctcctggtcaggcatgggacccaggtccccatagaagagtcggcagccctgagggttgctcacggtcatggtcctgcccgtactccttcccacggtactgaaacttgatgtccaggtcagtcattgggagagagctgatccacagttctggagagctatagaaggrctgtataggtgcctggggwacttccatctccaggggttcagttttgggccacactgcctccggsctgcagttgcccacactgcaattgcccacactggctggcgccatgggagaaccattgatgttcaggaaggggaaggtgtcctggatgggaacatggtgctgcgactgatccagctcatcttcctcatcttcttcatccacatcattatccttctcatcccagggagcagaccctgtggatcctgggttaatgatcgasccctggggctgagggatgtcacacacttgatatatcttcactgggttcatgggcacctcccttggtgccatccatacatccaggttgaattctctgctcttattgagagcacagcgcagctgggccttccatttagctgggtcagggtcatccaccccttcctggtacttccctgtctctacagcccaggccttaaaaatggtattttcctcttcttgttgagggctatgccgggtggcatgtttccagggaatctggaagcgtttagagtccctgtgtagccag

SEQ ID NO: 231 - DNA, 2043 bp, Homo sapiens
  SITE (901): n equals a,t,g, or c
tcagctggtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcamctccccttccctgagctccttcccaaggactcctggtcactgcctgctgtgcaktcagaggcccagggtccagcagcccggsgggaacgggtgctgcctsttcctccagttagctccagytcaggtctgagacccgtgytgagtaaaggtctgagcamcgaccgtgccctctgcccagggctgggtcctgagcagctggttttcctgcaggaaggttggagcaagcaaagtccttctctgccctcagggtcagctgcccagactggggcggatgcagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggngcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgttgttgttgttttactcacctaacccttagaaaatgaatgttagaaggtgcctgccgaggcgggacagagtgtttgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggyggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatctttaggttttttttttttcctgtttaccgcacaaactgaccacatggcatgtctatcaggatggagggtgtccatgttctcctctgtctttagggaggtgataaggagatggscgraggggtgtttttttctttgactcccctcctttctaacagaatgttgccaccactgcttgagtgggctgtgtttgttcctctgtcccagcttctgttgtagaaaataacattgttaggggaactcaggctagtgtcagcgtcttggtttgggg

SEQ ID NO: 232 - DNA, 629 bp, Homo sapiens
  SITE (624): n equals a,t,g, or c
ttaaggaattcggcmcgatcccggcaagtaacatgactaaaaagaagcgggagaatctgggcgtcgctctagagatcgatgggctagaggagaagctgtcccagtgtcggagagacctggaggccgtgaactccagactccacagccgggagctgagcccagaggccaggaggtccctggagaaggagaaaaacagcctaatgaacaaagcctccaactacgagaaggaactgaagtttcttcggcaagagaaccggaagaacatgctgctctctgtggccatctttatcctcctgacgctcgtctatgcctactggaccatgtgagcctggcacttccccacaaccagcacaggcttccacttggccccttggtcaggatcaagcaggcacttcaagcctcaataggaccaaggtgctggggtgttcccctcccaacctagtgttcaagcatggcttcctggcggcccaggccttgcctccctggcctgctggggggttccgggtctccagaaggacatggtgctggtccctcccttagcccaagggagaggcaataaagaacacaaagctgaaaaaaaaaaaaaaaaaaactcgtagggggggcccgtacccaatcgccctntcgtg

SEQ ID NO: 233 - DNA, 540 bp, Homo sapiens
taaaaagaagcgggagaatctgggcgtcgctctagagatcgatgggctagaggagaagctgtcccagtgtcggagagacctggaggccgtgaactccagactccacagccgggagctgagcccagaggccaggaggtccctggagaaggagaaaaacagcctaatgaacaaagcctccaactacgagaaggaactgaagtttcttcggcaagagaaccggaagaacatgctgctctctgtggccatctttatcctcctgacgctcgtctatgcctactggaccatgtgagcctggcacttccccacaaccagcacaggcttccacttggccccttggtcaggatcaagcaggcacttcaagcctcaataggaccaaggtgctggggtgttcccctcccaacctagtgttcaagcatggcttcctggcggcccaggccttgcctccctggcctgctggggggttccgggtctccagaaggacatggtgctggtccctcccttagcccaagggagaggcawtaaagacacaaagctggaaat

SEQ ID NO: 234 - DNA, 448 bp, Homo sapiens
aattgtgaaatattagaatattgttactatttgacccaactcaaaatctccatgggaaaatacctgtcgatacccacagtattgttgaaaataatcagatgcagtatcacagctgtgtcagactctagtaccagttgggcaatcaaggcacagctaaaaattgaaaacaaagatctggacaacaaaacagccaaaggtgggggtcaagaagctctgacgtgtacctagctgtagaatgctatgcacacgtgccaggtgtagtgtgcatatccaggaaaaactgcagagagccccagtcttcamctctggttgaccatgagctctgtgtaagcaggaagtgaaggctaaggcagatttaagctctgaaagcattccacaacatacacacaaatcgtgcaaagcattaaggaaatcttgttactgctaagtgttgctgacccaggaacaa

SEQ ID NO: 235 - DNA, 407 bp, Homo sapiens
gtatgctgccccaaaccaatatgtgtggctgcctttwacctgacttctccaacatgtagccccaagaggaggcctctagactragggaggggctggtgacccaggtgtggtggggctgcatgaractaccagagagacagacattctggaactcaccctgggggatccagtggatctgcctatggtctggtccaccccagacctgtgagatgttcctcatgaggatgcacttgtgcttctgcaagtattgctgcagcttcatagtgactcccaccagcaccagcaatacagytagctacctgtggccttggatctcagccagcatggctgggagagggagcarctgggcatgtaccctaaatgctgttaccagggaaggactcccagagtgaagacaagtagggact

SEQ ID NO: 236 - DNA, 830 bp, Homo sapiens
  SITE (92): n equals a,t,g, or c
  SITE (543): n equals a,t,g, or c
gtatttgatttcaggctgctaaatgggctcatttagcattcattccttgatgtagacattaaaaaaaaaactgaatagcattctttccaggntaactaataaagcagacatgctaagcctataaatacatcagcactgcagcacacgtttaaggttgccacggacaaggatcacacaatagagaacactgtagttcggtctgctcacaagacccagaacattgatcagtttttgttgttggtttattatttttctgttaaaaaattgtgaaaagtttgttttagctagatgatattttaatagctgcgagtgctttggaactataaagatgtcactacttaacacacataccttatgttttgttttgttttgttttacactcagtataaatcaggagaagttagccaaccatctagcatttagaatcctcttttttattgtcttctaaggatatggatgttcccataacagcaacaaaacagcaacaaaaacatttcataaatatcacttgatagactgtaagcacctgcttaactttgtgtnccaaatatttagtgtgtatatatatatatatatacacacacacacacatatatattcaacaaataaagcaaaatataacatgcatttcacattttgtctttccctgttacgattttaatagcagaactgtatgacaagtttaggtgatcctagcatatgttaaattcaaattaatgtaaaacagattaacaacaacaaagaaactgtctatttgagtgaagtcatgctttctattataataacttggcttcggttatccatcaaatgcacacttatactgttatctg

SEQ ID NO: 237 - DNA, 932 bp, Homo sapiens
  SITE (256): n equals a,t,g, or c
  SITE (599): n equals a,t,g, or c
ccagaagaaagaccaatctagaatatggaactctaatcacttctagtatttcaacttcctagcagaaatgaacttggccctagacctaggggataagcaatgttctttatgtagccaatgctacggaaacaaaagaggtgaaagagaccctttttttatacttaatgtacatatattgactttttgagcaagaatgccagaaatagccttcatttctaccctgcaaaataatccagatctgctttctaaaatgrantcagtttctaaagtgaaacatgcaatatttatgctctgactgactcctgaattggargaggaagracttctgtttacagaaaacygtattgttatatatgtcaggctgtgtattgtgactatcagcattctggtgcaaatgaacttttctccatcatcgactgtggaaaattgatacttttaaagcatattcttctatgagcacaggtcctcctagtgaaacttaatttgacaaagggtgtcatatgctttcctaacctgawttgtattaacattcacagagcctacattttctcattagggttrtgatgctcagtatctttccaagtgccaggcagrgcttnccttttctgatcaaacataccattttttgtatttcacaactatagacagtcacttctgcagtcccaatttaaaaatgcagaactgctttatccaagaatgctgaaaaatactgttctatccaggtttcctaaactataaaagcagattttgcttttgtttgttaatcataggcatggccgagcattgtggattagcctgaggcttaaaatcagatgcatgtctggtaagatgaccactgtctcactatcaagagcctgcagagccattttccagacctgtgattgcccagaacacatagtccccacgtttctaatttggagcaaatctaaaag

SEQ ID NO: 238 - DNA, 2786 bp, Homo sapiens
ttagcagggtgagctgttaaaacagcacacatctctcatcccctcttcctttattcccccctgggtttcagaaaggaaggatatatggggaccacctcccccttctttgatcccagcatctcagtccccctcccaaccctccatatggctctcaatggtgctcacttgcttggaagcaggctcccaatagggaggggsctgccctctacagtctctttgactgtaagacagggctctgtatcagtgagacgatgagaaaagtcccaggctaatggcagaaatttgcactttgaacatgtgtgtttttgtgttgtggaacctgagattccttatttattaacaggaagtctgattttttttttttggagtctttgttgctatattttgtggggctgggagagagagattagattattttgacatgggatcccttccataacaggtactttgaaggcaagacatagggttgaagaagcacaaccagcctctgaaatcatagctctccagtggcttttaaagaaagctggtcctcagcactaacaaaatcactacaatagcctagtgcttttttggaagcctttttagggaagaatgttaggttcatggtaactagtatgctctttgagatttttacagtgttgaaacttaagaattttgagagggtgaggagggttgttcagaatctaaattacagatagatgattgtttcttgtgaatttgtttcttttcctttttttttgtccctaccatttccttacatttcccttggggcccatctctggctccttgctttttgtttcttgctttgctttatcagttcattccagctccctgttagtgaaggacactgctgttagtgaaggaacaaagtctatgagtcctaaaattttaagtcaaagaaaactgctctgtttcccctttagtaacacttctgaagaggaaaaacttcaatagccaaagttaataatcctatataataattgctttggctttcacctaaaattctgggcatcacaatttccttgggatagaggttgtgttggggaatagattgcttattgctgttcactggagagaaaaggtagtgtttttgtacaaggtcataccgccagaagccccaaatcctattttggctcatcttcaggtaaagagtaattcctatcctgtgtgcctcagaagctagaatcgaaggcttaccctattcattgtttattgtcagaaatgcatgatggctcttggaaagaatgacgttttgctggaaaaaaaaaaaagaacagtttgtgtttcacaaacatggcttatcaattttttcaaagaattcttttttcccaaaaagaggagtaacaaaatgtcatttctgaaagaggcttactttataccaactagtgtcagcatttgggatgccagggaacagagagtgagacacctacaatcaccagtctcaaatgcgctattgtttcttttcagagtgttgcagatttgccatttctccataatatggggatagaaaatggaataaagatagaagggatgtagaatatgctttcctgccaacatggtttggagtcgactttggtatattgactagatttgaaaatacaagattgattagatgaatctacaaaaaagttgtcctcctctcaggtcccttttacactttttgactaactagcatctatattccacacttagcttttttgtcacacttatcctttgtctccgtaaatttcatttgcagtggttagtcatcagatattttagccacctacacaaaagcaaactgcatttttaaaaatctttctgagatgggagaaaatgtattctcctttcctataccgctctcccaacaaaaaaacaactagttagttctactaattagaaacttgctgtactttttcttttcttttaggggtcaaggaccctctttatagctaccatttgcctacaataaattattgcagcagtttgcaatactaaaatattttttatagactttatatttttccttttgataaagggatgctgcatagtagagttggtgtaattaaactatctcagccgtttccctgctttcccttctgctccatatgcctcattgtccttccagggagctcttttaatcttaaagttctacatttcatgctcttagtcaaattctgttacctttttaataactcttcccactgcatatttccatcttgaattggtggttctaaattctgaaactgtagttgagatacagctatttaatatttctgggagatgtgcatccctcttcttkgtggttgcccaaggttgttttgcgtaactgagactccttgatatgcttcagagaatttaggcaaacactggccatggccgtgggagtactgggagtaaaataaaaatatcgaggtatagactagcatccacatagagcacttgaacctcctttgtacctgtttggggaaaaagtataatgagtgtactaccaatctaactaagattattatagtctggttgtttgaaataccatttttttctccttttgtgtttttcccactttccaatgtactcaagaaaattgaacaaatgtaatggatcaatttaaaatattttatttcttaaaagccttttttgcctgttgtaatgtgcaggacccttctcctttcatgggagagacaggtagttacctgaatataggttgaaaaggttatgtaaaaagaaattataataaaagggatactttgcttttcaaatctttgttttctcttattctaggtaaggcatattaaaaataaatatgt

SEQ ID NO: 239 - DNA, 458 bp, Homo sapiens
gggtgcaggaattcggcacgagagaatgtttgattttctttcctattttaaggatcttctctcttgttgatgttgaaaacttaccttagtgaagatgtgtttcaacatgctgttgtcctttacctgcataatcacagctatgcatctattcaaagtgatgatctgtgggatagttttaatgaggtcacaaaccaaacactagatgtaaagagaatgatgaaaacctggaccctgcagaaaggatttcctttagtgactgttcaaaagaaaggaaaggaactttttatacaacaagagagattctttttaaatatgaagcctgaaattcagccttcagatacaaggtacatgccctctttcttttcatgccatctcttttgcactctcaggtggaaatatttttaagtgttttataatcataagttcttgtgaaacctaacaagattatcccttcctaa

SEQ ID NO: 240 - DNA, 591 bp, Homo sapiens
  SITE (495): n equals a,t,g, or c
  SITE (516): n equals a,t,g, or c
aggatgaagaggaaattatctcttggattgctctccaggaaatccttctctatactttaaaagctcttgttcttttctaggartccaatgtgctgattgctgctaacagtcagggtacaattaaggtgctagaattggtatgaagggttaactcaagtcaaattgtacttgatcctgctgaaatacatctgcagctgacaatgagagargaaacagaaaatgtcatgtgatgtctctccccaaagtcatcatgggttttggatttgttttgaatattttttctttttttcttktccctcctttatgagcctttgggacattgggaatacccagccaactctccaccatcaatgtaactccatggacattgctgctcttggtggtgttatctaatttttgtgatagggaaacaaattcttttgaataaaaataaataacwaaacaataaaagtttattgagccacagttgagcttggaaagtttttgtcaaatgcngcaagagataactctttttangaagtagcatatgtgaactataatgtaacagtgaataatttgtaaagttcgtatttcccaacctctttgggaatt

SEQ ID NO: 241 - DNA, 2449 bp, Homo sapiens
  SITE (1375): n equals a,t,g, or c
ggcacgagcctttctgaagattaaaaaacaaataaaaagttgagaagaaagagcacgaagagtagaagggaacaatggtgtactcgccagcaatggcaatacgggttattaaaaagaagggtgggggcggggaaccctggccgactcaggacgccacgggaggaagccacgcaaaatagcaaaccgggatcctagaggggcggggcccacctcagcgcgcaggcgcaaccaggcccaggtggccgccgcggaagcgaaccacctatacgcgccgcgccgcttgggtctcctgcgcatgcgcagacasctgcgctggaggcttcatctttgccgccgctgccgtcgccttcctgggattggagtctcgagctttcttcgttcgttcgycggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcgatgaaaatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggtacagcagggaagaactggaaactcagagaaagaaactgcccttccatctacaaaagctgagtttacttctcctccttctttgttcaagactgggcttccaccgagcagaaacagcacttcttctcagtctcagacaagtactgcctccagaaaagccatttcaagcgttggggaagtgggcaggwtcgatatgggagggccgawtcacctgatctaaggagattacctggggcaattgatgttatcggtcagactatwacyatcagccgagtagaaggcaggcgacgggcaaatnagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggtattccaataactgtaccacctccaggttttcctcctccaccaggcgctccacctccatctcttataccaacaatagaaagtggacattcctctggttatgatagtsgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtactatttcaaaaataaaaagacagcaatgactttatatccaaaaaaaaaaaaaaaaaaaaaaaaaaaaaagggcggcc

SEQ ID NO: 242 - DNA, 1286 bp, Homo sapiens
  SITE (555): n equals a,t,g, or c
  SITE (1245): n equals a,t,g, or c
  SITE (1269): n equals a,t,g, or c
tctttttaaggtacagcagggaagaactggaaactcagagaaagaaactgcccttccatctacaaaagctgagtttacttctcctccttctttgttcaagactgggcttccaccgagcaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggttttcctcctccaccaggcgctccacctccatctcttataccaacaatagaaagtggacattcctctggttatgatagtsgttctgcacgtgcatttccatatggcaatgcgatgaagaacgatacagatacagggaatatgcagaaagaggttatgagcgtcacagagcaagtcgagaaaangaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtactatttcaaaaataaaaagacagcaatgactttatatccaagaaaggaatgtgaatgagtcacttaacagggaatctaaagagctgtgttagctgtgtacatacacagattatctgagaaaaggtcaagggttccacttgggccacagtttttttgttaatcaaacaccactctcttaagrggctgcatcacaaarggcaaccaargggcccctcttarggctttgaggattaaaactagtctttatccattactgctgtggacactcttggcttrgtatwtttaggggggntccttacctttttttggttttccncacctttttggttgggc

SEQ ID NO: 243 - DNA, 734 bp, Homo sapiens
atggcagcgcagaaggaccagcagaaagatgccgaggcggaagggctgagcggcacgaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtggtgacgtcccctatgttgctggtggctctggctgtctttttcggcgcctgttaacattctctatctgcgcaccttggagtccaagcttgtcctctttggccgaaaggtgagcccagcgcatcatatgctctggctggaggcatctccttccccttcttctggctggctggtgcgggctcggccgtcttctgggtgctgggagccaccctggtggtcatcggctcccacgctgccttccaccagattgaggctgtggacggggaggagctgcagatggaacccgtgtgaggtgtcttctgggacctgccggcctcccgggccagctgccccacccctgcccatgcctgtcctgcacggtctgctgctcgggcccacagcgccgtcccatcacaagcccggggagggatcccgcctttgaaaataaagctgttatgggtgtcattcaaaaaaaaaaaaaaaaaaaa

SEQ ID NO: 244 - DNA, 809 bp, Homo sapiens
cggggtcttcagggtaccgggctggttacagcagctctacccctcacgacgcaracatggcagcgcagaaggaccagcagaaagatgccgaggcggaagggctgagcggcacgaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtggtgacgtcccctatgttgctggtggctctggctgtctttttcggcgcctgttacattctctatctgcgcaccttggagtccaagcttgtgctctttggccgagaggtgagcccagcgcatcagtatgctctggctggaggcatctccttccccttcttctggctggctggtgcgggctcggccgtcttctgggtgctgggagccaccctggtggtcatcggctcccacgctgccttccaccagattgaggctgtggacggggaggagctgcagatggaacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcaggaaaaaaaaaaaaaaaaaaaaaaaaaaaaaaaaaaa

SEQ ID NO: 245 - DNA, 2201 bp, Homo sapiens
tcgacccacgcgtccggcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggcggatgamccggacgacgggccagtgcctggcaccccggggttgccarggtccamggggaacccgaagtccgaggagcccgargtcccgaaccaggargggctgcagcgcatcamcggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggaccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttmatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcactttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagargctgccgctcacctacctgcacatctgccacagctggccctgggcccaccccacgaagggcctgggcctaaccccttggcctggcccagcttccagagggaccctgggccgtgtgccagctcccagacactacmtgggtagctcaggggaggaggtgggggtccaggagggggatccctctccacaggggcagccccaagggctcggtgctatttgtaacggaataaaatttgtagccagaccccaggtgcctgctctcgtctttctctgggtggcctctgatcttgcaccccgtcttcaccccagggctcctgaagactgtgggt

SEQ ID NO: 246 - DNA, 1661 bp, Homo sapiens
  SITE (1200): n equals a,t,g, or c
  SITE (1536): n equals a,t,g, or c
gtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatscttcatccccggagagcatttctggctgctcctcctgacccggggcctggtgggggtcggggaggccagttattccaccatcgcgcccactctcattgccgacctctttgtggccgaccagcggascggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatytgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggytccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcactttcctgggcaccgncatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctkgccctgggcccaccccacgaagggcctgggcctaaccccttggcctggcccagcttccagagggaccctgggccgtgtgccagctcccagacactacmtgggtagctcaggggaggaggtgggggtccaggagggggatccctctccacaggggncaccccaagggctcggtgctatttgtaacggaataaaatttgtagccagaccccaggtgcctgctctcgtctttctctgggtggcctctgatcttgcaccccgtcttcaccccagggctcctgaa

SEQ ID NO: 247 - DNA, 1146 bp, Homo sapiens
  SITE (1): n equals a,t,g, or c
  SITE (214): n equals a,t,g, or c
  SITE (268): n equals a,t,g, or c
ngacagaaaagcagaagatgagactctgttcattcacttttcctaggcccatcctgtggtcatctttccccctcccatcatacctcctccttcctggagcctctgccggcttggctgtaatggtggcacttacctggatatttcagtgggaggatgaaaggcgagactcaccctacgcggtgggacagatggggagaggaaaaaggcagagatngccaggagaggggtgcaggacaaaccagagaggttgggtcaggggaaaagtgtngggagaaagtggggtgcaggccctgcaggccggtttagccagcagctgcggcctccccgggcccttggcatccaacttcgcagacagggtaccagcctcctggtgtgtatcataggatttgttcacatagtgttatgcatgatcttcgtaaggttaagaagccgtggtggtgcaccatgacatccaacccgtatatataaagataaatatatatatatatgtatgtaaattatagcactgagggccctgctgccctgctggaccaagcaaaactaagccttttggtttgggtattatgtttcgttttgttatttgtttgtttttgtggcttgtcttatgtcgtgatagcacaagtgccagtcggattgctctgtattacagaatagtgtttttaattcatcaatgttctagttaatgtctacctcagcacctcctcttagcctaattttaggaggttgcccaattttgtttcttcaattttactggttacttttttgtacaaatcaatctctttctctctttctctcctccccacctctcacccttgccctctccatctccctctcccgccctcccctcctccctctggctccccgtctcatttctgtccactccattctctctccctctctcctgcctcctgctgccccctccccagcccacttscccgagttgtgcttgccgctccttatctgttctagttccgaagcagtttcactcgaagttgtgcagtcctggttgcagctttccgcatctgccttcgtttcgtgtagattgacgcgtttctttgtaatttcagtgtttctgacaagatttaaaaaaaaaaaaaggaaaaaaaaaaaaaaaaaaaactcgagggggggcccggtacccaattg

SEQ ID NO: 248 - DNA, 1350 bp, Homo sapiens
  SITE (334): n equals a,t,g, or c
  SITE (1346): n equals a,t,g, or c
  SITE (1349): n equals a,t,g, or c
aacccacggctgctgcggcagggcgtggagggcagagggccgcggaggcgcagttgcaaacatggctcagagcagagacggcggaaacccgttcgccgagcccagcgagcttgacaacccctttcagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaaggagncgagagctgcagcatgctgccctgggrggcacagctactcgacagaacaattggccccctctaccttctttttgtccagttcagccctgctttttccaggacatctccatggagatcccccaagaatttcagaagactgtatccaccatgtactacctctggatgtgcagcacgstggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttttcttcttcattttcttcgtccaggatgtgctctttgtcctccaggccattggtatcccaggttggggattcagtggctggatctctgctctggtggtgccgaaggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcarcttgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaaaaaaaaaaaaaaaaaaaaaaaaaaggggggnccnc

SEQ ID NO: 249 - DNA, 2503 bp, Homo sapiens
  SITE (2193): n equals a,t,g, or c
ggcacgagcgaaggcaagggggcaccagctcaggactgcatctgcctgccatttcccttccactcctcctttctggagtctgacattagaaagccagcgagaaggaagattcaaacaaccaaccctgatttcctgcttctccttttcatgagtgttcctgtggtctctgcacctcctttctgtcccccggcagagggcagtagagatggccggcccaaggcctcrgtggcgcgaccagctgctgttcatgagcatcatagtcctcgtgattgtggtcatctgcctgatgttatacgctcttctctgggaggctggcaacctcactgacctgcccaacctgagaatcggcttctataacttctgcctgtggaatgaggacaccagcaccctacagtgtcaccagttccctgagctggaagccctgggggtgcctcgggttggcctgggcctggccaggcttggcgtgtacgggtccctggtcctcaccctctttgccccccagcctctcctcctagcccagtgcaacaktgatgagagagcgtggcgsctggcagtgggcttcctggctgtktcctctgtgctgctggcaggcggcctgggcctcttcctctcctatgtgtggaatgggtcargctctccctcccggggcctgggtttctagctctgggcagcgcccagsccttactcatcctcttgcttatagccatggctgtgttccctctgagggctgagagggctgagagcaagcttgagagctgctaaaggcttacgtgattgcaagggttcagttccaaccatggtcagaggtggcacatctgctcagccatctcattttacagctaacgctgatctccagctccagcgatggaacccactacagaggaggtggggcccctgtgtcaaagaggccgaggggcagcaagggcagmcagggcacctgtgacttcttagtacaagattgtctgtccttcaggacttccaaggctcccaaagactccctaaaccatgcagctcattgtcacaccaattcctgctttaattaatggatctgagcaaatcttcctctagcttcaggagggtggggagggagtgattgctgtcatggggccagacttccaggctgatttgccaaatgccaaaatgaaacctagcaaagaacttacggcaacaaacgaggacattaaaagagcgagcacctcagtgtctctggggacatggttaaggagcttccactcagcccaccatagtgagtgggccgccataagccatcactggaactccaaccccagaggtccaggagtgatctctgagtgactcaacaaagacaggacacatggggtacaaagacaaggcttgactgcttcaaagcttccctggacctgaagccagacagggcagaggcgtccgctgacaaatcactcccatgatgagaccctggaggactccaaatcctcgctgtgaacaggactggacggttgcgcacaaacaaacgctgccaccctccacttcccaacccagaacttggaaagacattagcacaacttacgcattggggaattgtgtgtattttctagcacttgtgtattggaaaacctgtatggcagtgatttattcatatattcctgtccaaagccacactgaaaacagaggcagagacatgtactctggtgtgatctcttgtcctcagtgtctcttctgggctcctgtccctcttgctttatagctagctgcccggggaccaaggtacaggtgaaagcaaggtagcagcttgcgggaggaggcctgtctggcttaccagtctatacactgtggcctcaacctcccagacagggcagagaactgtgggcagctcgtttgctttctaggctggctggagaggtgggagctcattgatagactcatgatggaaactatttttgaaacaggcttcctccttcaggagagatcatgcggactaaactgtagcaattccagtgcacctggcagtgatccttttctttgcaaagtactgtctctttggttccagtaagttggaccaccacatgacatyattttccctggaacctggtcactgactaacacagacaattgggactccagagcctcaagagccaggagagggcacagtacatacagagggagtcaaatgggatctcattttgagtcctgccttccgcacactcagaacggcanccccaaggcccggagtgtccagggcttctggcctgaggtgaatctgccaggcccaagaaggcacaaaggtaggagcacagagagccccattcccacaggcggkcggcccagcagcaccagtggaagctcagctgtcctccagctgctctcggcagacagttcagtgcacagtttatgccctagctgaaaaagatctcccggacgtatttcagcacatcctcttcctcctcctcctcagggctcctgctacaggcagagctggaaccccccggcctctgggaagggctgaggcctggagycagtgcctgtc

SEQ ID NO: 250 - DNA, 1529 bp, Homo sapiens
tcccagaggccggggggttccagctctgcctgtagcagagccctgaggaggaggaggaagaggatgtgctgaaatacgtccgggagatctttttcagctagggcataaactgtgcactgaactgtctgccgagagcagctggaggacagctgagcttccactggtgctgctgggccgmccgcctgtgggaatggggctctctgtgctcctacctttgtgccttcttgggcctggcagattcacctcaggccagaagcccctggacactccgggccttggggtgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatratgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatgcgtaagttgtgctaatgtctttccaagttctgggttgggaagtggagggtggcagcgtttgtttgtgcgcaaccgtccagtcctgttcacagcgaggatttggagtcctccagggtctcatcatgggagtgatttgtcagcggacgcctctgccctgtctggcttcaggtccagggaagctttgaagcagtcaagccttgtctttgtaccccatgtgtcctgtctttgttgagtcactcagagatcactcctggacctctggggttggagttccagtgatggcttatggcggcccactcactatggtgggctgagtggaagctccttaaccatgtccccagagacactgaggtgctcgctcttttaatgtcctcgtttgttgccgtaagttctttgctaggtttcattttggcatttggcaaatcagcctggaagtctggccccatgacagcaatcactccctccccaccctcctgaagctagaggaagatttgctcagatccattaattaaagcaggaattggtgtgacaatgagctgcatggtttagggagtctttgggagccttggaagtcctgaaggacaaacaatcttgtactaagaa

SEQ ID NO: 251 - DNA, 1537 bp, Homo sapiens
  SITE (1516): n equals a,t,g, or c
  SITE (1532): n equals a,t,g, or c
gtgcgaggtccccgccagcccccagcggccttcccggcccggggcgctcccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattraggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaawraaaaaaaaaaaaaaagggnggccgctctagagganccaag

SEQ ID NO: 252 - DNA, 506 bp, Homo sapiens
tgcaggatttggccaggacccsccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggatattatcaactcactggtaacaacagtattcatgctcatcgtatctgtgttggcactgataccagaaaccacaacattgacagttggtggaggggtgtttgcacttgtgacagcagtatgctgtcttgccgacggggcccttatttaccggaagcttctgttcaatcccagcggtccttaccagaaaaagcctgtgcatgaaaaaaaagaagttttgtaattttatattactttttagtttgatactaagtattaaacatatttctgkattattccaaaaaaaaaaaaaaaaaaaaaaaaaatttggtgg

SEQ ID NO: 253 - DNA, 1348 bp, Homo sapiens
  SITE (12): n equals a,t,g, or c
gtctttcttttnctgttttgagttggtgagtgagtgaatagggtaacatgggccttcaggatgaccccttggaactgtgccgagttccttaaatctcagctgggatcctggacctgggaggcccctgtgagggccagctctggaaaaacctgggagttgatgccggaggytgggaagaactctgctcgagggcagggtgccctggaacactggtagttctggggctgggagggagaggggctccggctttctctgaaatgaacactgctcttcagcagttcaagtacttgttctcaaaacattttctaattgattggtaggttttcataagcattgtttctttaaggcatggaaagggaagaatgctcaagcaagtcatgtttgttttcagtgggatgggcccgcgttctcactgctgggggcttccccttgcatgtggcacctttgtgcagggccaccaggcagactcttcccaccttctcccactgaagcaccaaggggcttgaaccgtaatttggctaatcagaggcattttttttgtcctagtatctttcacacttgtccaaccgtcttatttttttaaaagttctgttgcttgtattaacacgaaactagagagaaatagtttctgaagccagtttattgtgaagatccccaaggggaggttcggtagagaaaaatagtaagctggtttagaaactgacgagggcaaacagccaggacgcattggagaggaatttgccaaagatctaccctgagataacgcctgtccagtgtcttcaccacgtgaataaccagcgctccaaagtgtttttctgctttgaaaaaaaaaattccacaagcttttaaaggtgcatttaagaatccatgtgactttagaatggaactgccggccctggcaactgtcacgtgtgctagaaggttcgatgcctctggaatgcatgtgatactcatctccattttgtttccttgattgcatttttgttcttttagcagatctgtccctgtgggtggtgtctaagaagtcggacaccttggtttttgtgttagattgagctgggcagctgcaatcagcttctttatatgcaaattaggcacgacccatctgtggttccctggttggtggctaatgaagtgaggggagggagggatgtcaccccaaaagtaggccctcccattggctttggccaggccagacacttcacatcgtttacatggttctgtgtaattttaaagtttatgtgtataaagcgaagctgtttctgtgaaactgtatattttgtaaataaatatattgctactttgagawraaaaaaaaaaaaaaactcgaggggggcccggtacccaa

SEQ ID NO: 254 - DNA, 1766 bp, Homo sapiens
gtgccgaatcggcagagcggcacgagcggccacgagagcaggcggagtaaagggacttgagcgagccagttgccggattattctatttcccctccctctctcccgccccgtatctcttttcacccttctcccaccctcgctcgcgtascatggcggagcgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaargctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaaaaaaaaaaaactcgaggggggcccggtacccaaatcgccggatatgatcgtaaa

SEQ ID NO: 255 - DNA, 2664 bp, Homo sapiens
  SITE (2623): n equals a,t,g, or c
  SITE (2640): n equals a,t,g, or c
  SITE (2652): n equals a,t,g, or c
  SITE (2662): n equals a,t,g, or c
agtgtcctcggagcaggcggagtaaagggacttgagcgagccagttgccggattattctatttcccctccctctctcccgccccgtatctcttttcacccttctcccaccctcgctcgcgtascatggcggagcgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaargctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggattttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaacamaaaaaaaaaaaaaaaaagggcggccgctctagaggatccaagcttacgtacgcgtgcatgcgacgtccatagctctttctataggggtcccccaaattccattcancgggccgtcggttttanaaaggtcgtgantgggggaaancc

SEQ ID NO: 256 - DNA, 865 bp, Homo sapiens
cgtgggagtgaggtaccagattcagcccatttggccccgacgcctctkttctcggaatccgggtgctgcggattgaggtcccggttcctaacggtgggatcggtgtcctcgggatgagatttggcgtttcctcggggctttggtgggatcggtgtcctcaggatgagatttagggtttcctcggggctttcgggatcttcacctaatatccggactgcaagatggaggaaggcgggaacctaggaggcctgattaaratggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttcttcagaaaaaaaaaaaaaaaaaactcgaggggggcccggtaccca

SEQ ID NO: 257 - DNA, 2082 bp, Homo sapiens
  SITE (10): n equals a,t,g, or c
  SITE (28): n equals a,t,g, or c
  SITE (37): n equals a,t,g, or c
tggggggggnaatgggtgtctggctcanggattgccnaatctggaaattctccataacttgctagcttgttttttttttttttttttacacccccccgccccacccccggacttgcacaatgttcaatgatctcagcagagttcttcatgtgaaacgttgatcacctttgaagcctgcatcattcacatattttttcttcttcttccccttcagttcatgaactggtgttcattttctgtgtgtgtgtgtgttttattttgtttggatttttttttttaattttacttttagagcttgctgtgttgcccaccttttttccaacctccaccctcactccttctcaacccatctcttccgagatgaaagaaaaaaaaaagcaaagtttttttttcttctcctgagttcttcatgtgagattgagcttgcaaaggaaaaaaaaatgtgaaatgttatagacttgcagcgtgccgagttccatcgggttttttttttagcattgttatgctaaaatagagaaaaaaatgctcatgaaccttccacaatcaagcctgcatcaaccttctgggtgtgacttgtgagttttggccttgtgatgccaaatctgagagtttagtctgccattaaaaaaactcattctcatctcatgcattattatgcttgctactttgtcttagcaacaatgaactataactgtttcaaagactttatggaaaagagacattatattaataaaaaaaaaaagcctgcatgctggacatgtatggtataattattttttcctttttttttccttttggcttggaaatggacgttcgaagacttatagcatggcattcatacttttgttttattgcctcatgacttttttgagtttagaacaaaacagtgcaaccgtagagccttcttcccatgaaattttgcatctgctccaaaactgctttgagttactcagaacttcaacctcccaatgcactgaaggcattccttgtgcaaagataccagaatgggttacacatttaacctggcaaacattgaagaactcttratgttttctttttaataagaatgacgccccactttggggactaaaattgtgctattgccgagaagcagtctaaaatttattttttaaaaagagaaactgccccattatttttggtttgttttatttttattttatattttttggcttttggtcattgtcaaatgtggaatgctctgggtttctagtatataatttaattctagtttttataatctgttagcccagttaaaatgtatgctacagataaaggaatgttatagataaatttgaaagagttaggtctgtttagctgtagattttttaaacgattgatgcactaaattgtttactattgtgatgttaaggggggtagagtttgcaaggggactgtttaaaaaaagtagcttatacagcatgtgcttgcaacttaaatataagttgggtatgtgtagtctttgctataccactgactgtattgaaaaccaaagtattaagaggggaaacgcccctgtttatatctgtaggggtattttacattcaaaaatgtatgtttttttttcttttcaaaattaaagtatttgggactgaattgcactaagatataacctgcaagcatataatacaaaaaaaaattgcaaaactgtttagaacgctaataaaatttatgcagttataaaaatggcattactgcacagttttaagatgatgcagatttttttacagttgtattgtggtgcagaactggattttctgtaacttaaaaaaaaatccacagttttaaaggcaataatcagtaaatgttattttcagggactgacatcctgtctttaaaaagaaatgaaaagtaaatcttaccacaataaatataaaaaaatcttgtcagttacttttcttttacatattttgctgtgcaaaattgttttatatcttgagttactaactaaccacgcgtgttgttcctatgtgcttttctttcattttcaattctggttatatcaagaaaagaataatctacaataataaacggcatttttttttgaaaaaaaaaaaaaaaaaa

SEQ ID NO: 258 - DNA, 1482 bp, Homo sapiens
caggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaaccaaaaaaaaaaaaaaaaaactcgaggggggcccgta

SEQ ID NO: 259 - DNA, 834 bp, Homo sapiens
ggcacgagcgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctcaggactgcaccttagggcagtgtccgtcagtgccctctccamctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaaccacgaaaaaaaaaaaaaaaaaaaa

SEQ ID NO: 260 - DNA, 1508 bp, Homo sapiens
  SITE (1481): n equals a,t,g, or c
ttgaacttttaaaattttagatcagcaaactctaagatcctagaatggaagctgttcctcatttctccatgctcaccctcccaggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatctatagagagagatatatacacttttgattgttttctagatgtctaccaataaatgcaatttgtgacctgtattaaaaaaaantaaaaaaactcgaggggggcccggtac

SEQ ID NO: 261 - DNA, 2514 bp, Homo sapiens
gagagactcacacttcttttccattatcactgacgatgtagtggacatagcaggggaagagcacctacctgtgttggtgaggtttgttgatgaatctcataacctaagagaggaatttataggcttcctgccttatgaagccgatgcagaaattttggctgtgaaatttcacactatgataactgagaagtggggattaaatatggagtattgtcgtggccaggcttacattgwctctagtggattttcttccaaaatgaaagttgttgcttctagacttttagagaaatatccccaagctatctacacactctgctcttcctgtgccttaaatatgtggttggcaaaatcagtacctgttatgggagtatctgttgcattaggaacaattgaggaagtttgttcttttttccatcgatcaccacaactgcttttagaacttgacaacgtaatttctgttctttttcagaacagtaaagaaaggggtaaagaactgaaggaaatctgccattctcagtggacaggcaggcatgatgcttttgaaattttagtggaactcctgcaagcacttgttttatgtttagatggtataaatagtgacacaaatattagatggaataactatatagctggccgagcatttgtactctgcagtgcagtgtcagattttgatttcattgttactattgttgttcttaaaaatgtcctatcttttacaagagcctttgggaaaaacctccaggggcaaacctctgatgtcttctttgcggccggtagcttgactgcagtactgcattcactcaacgaagtgattggaaaatattgaagtttatcatgaattttggtttgaggaagccacaaatttggcaaccaaacttgatattcaaatgaaactccctgggaaattccgcagagctcaccagggtaacttggaatctcagctaacctctgagagttactataaagaaaccctaagtgtcccaacagtggagcacattattcaggaacttaaagatatattctcagaacagcacctcaaagctcttaaatgcttatctctggtaccctcagtcatgggacaactcaaattcaatacgtcggaggaacaccatgctgacatgtatagaagtgacttacccaatcctgacacgctgtcagctgagcttcattgttggagaatcaaatggaaacacagggggaaagatatagagcttccgtccaccatctatgaagccctccacctgcctgacatcaagttttttcctaatgtgtatgcattgctgaaggtcctgtgtattcttcctgtgatgaaggttgagaatgagcggtatgaaaatggacgaaagcgtcttaaagcatatttgaggaacactttgacagaccaaaggtcaagtaacttggctttgcttaacataaattttgatataaaacacgacctggatttaatggtggacacatatattaaactctatacaagtaagtcagagcttcctacagataattccgaaactgtggaaaatacctaagagacttttaaaaataggctttcttatatttgatatttggaagaaaaagccgtaagtgtatgtagaccacttaatcactaaatatctttgcctataggactccattgaatacattagccattgataatctacctgtttaaatggcccctgtttgaactctcaagctttgaagacctacctgttcttccagaagagaacgttgaaagtgccatgtttccttttgcgtgatctctgttgatggcactctggaattgtttcagttaagtcattttagacatagcatttattatcactgtggatctctacttgttgggtgttatgaattctttgaagaaatatattttgaagaggtgtgggaggaaggaatacattttataaaatgttgtagtgaagcccacaattgacctttgactaataggagttttaagtatgttaaaaatctatactggacagttacaagaaattaccggagaaaagcttgtgagctcaccaaacaaggatttcagtgtagattttgtctttcttgaacttaaagaaacaaatgacaaagtttgaatggaaaagcctgctgttgttccacatctcgttgctgtttacattcctttgtggagcctacatcttcctaagctttttagcaggtatatgttgaacacttctgtttcatggttgagacagaatcagaggccatggatactgacaactgatttgtctgttttttttctctgtctttttccatgactcttatatactgcctcatcttgatttataagcaaaacctggaaaacctacaaaataagtgttgtggtttatctagaaaaatatggaaaatattgctgttatttttggtgaagaaaatcaattttgtatagtttatttcaatctaaataaaatgtgaattttgtttaaagcttaggcacattattttttgtggggtcaaaacattcttgtgtaaattctcttaaacatttgataaacagcttcacaattc

SEQ ID NO: 262 - DNA, 2357 bp, Homo sapiens
  SITE (686): n equals a,t,g, or c
ctgccttatgaagccgatgcagaaattttggctgtgaaatttcacactatgataactgagaagtggggattaaatatggagtattgtcgtggccaggcttacattgtctctagtggattttcttccaaaatgaaagttgttgcttctagacttttagagaaatatccccaagctatctacacactctgctcttcctgtgccttaaatatgtggttggcaaaatcagtacctgttatgggagtatctgttgcattaggaacaattgaggaagtttgttcttttttccatcgatcaccacaactgcttttagaacttgacaacgtaattyctgttctttttcagaacagtaaagaaaggggtaaagaactgaaggaaatctgccattctcagtggacaggcaggcatgatgcttttgaaattttagtggaactcctgcaagcacttgttttatgtttagatggtataaatagtgacacaaatattagatggaataactatatagctggccgagcatttgtactctgcagtgcagtgtcagattttgatttcattgttactattgttgttcttaaaaatgtcctatcttttacaagagcctttgggaaaaacctccaggggcaaacctctgatgtcttctttgcggccggtagcttgactgcagtactgcattcactcaacgaagtgantggaaaatattgaagtttatcatgaattttggtttgaggaagccacaaatttggcaaccaaacttgatattcaaatgaaactccctgggaaattccgcagagctcaccagggtaacttggaatctcagctaacctctgagagttactataaagaaaccctaagtgtcccaacagtggagcacattattcaggaacttaaagatatattctcagaacagcacctcaaagctcttaaatgcttatctctggtaccctcagtcatgggacaactcaaattcaatacgtcggaggaacaccatgctgacatgtatagaagtgacttacccaatcctgacacgctgtcagctgagcttcattgttggagaatcaaatggaaacacagggggaaagatatagagcttccgtccaccatctatgaagccctccacctgcctgacatcaagttttttcctaatgtgtatgcattgctgaaggtcctgtgtattcttcctgtgatgaaggttgagaatgagcggtatgaaaatggacgaaagcgtcttaaagcatatttgaggaacactttgacagaccaaaggtcaagtaacttggctttgcttaacataaattttgatataaaacacgacctggatttaatggtggacacatatattaaactctatacaagtaagtcagagcttcctacagataattccgaaactgtggaaaatacctaagagacttttaaaaataggctttcttatatttgatatttggaagaaaaagccgtaagtgtatgtagaccacttaatcactaaatatctttgcctataggactccattgaatacattagccattgataatctacctgtttaaatggcccctgtttgaactctcaagctttgaagacctacctgttcttccagaagagaacgttgaaagtgccatgtttccttttgcgtgatctctgttgatggcactctggaattgtttcagttaagtcattttagacatagcatttattatcactgtggatctctacttgttgggtgttatgaattctttgaagaaatatattttgaagaggtgtgggaggaaggaatacattttataaaatgttgtagtgaagcccacaattgacctttgactaataggagttttaagtatgttaaaaatctatactggacagttacaagaaattaccggagaaaagcttgtgagctcaccaaacaaggatttcagtgtagattttgtctttcttgaacttaaagaaacaaatgacaaagtttgaatggaaaagcctgctgttgttccacatctcgttgctgtttacattcctttgtggagcctacatcttcctaagctttttagcaggtatatgttgaacacttctgtttcatggttgagacagaatcagaggccatggatactgacaactgatttgtctgttttttttctctgtctttttccatgactcttatatactgcctcatcttgatttataagcaaaacctggaaaacctacaaaataagtgttgtggtttatctagaaaaatatggaaaatattgctgttatttttggtgaagaaaatcaattttgtatagtttatttcaatctaaataaaatgtgaattttgtttaaagcttaggcacattattttttgtggggtcaaaacattcttgtgtaaattctc

SEQ ID NO: 263 - DNA, 689 bp, Homo sapiens
  SITE (644): n equals a,t,g, or c
actttctggtgcaaaaagatgttcaagccttattttatacttgcctgcccctttctctttcatttattggagtgagctgcagctctaagaagacctgttcttttgaatggagagtagcatcaggaaccaggatgtgggtgcgaggcgtgctcctggctgttgcagattgctgcacccgggagctcttagtggacagagctagaggatatgtgcacgtacttccatctctctctctgtctccgattttagcccagcaccacagggtacgttccagtttttctctctttccatagctgtaaggccctttctgggaatggttctcattctccttaatctattattgggtcagttttcctgcatgtccccagcctcccatcactgccacccactccccacagagatgccctgctcatccgactggggctttgactcccacactgtgtacccctcttgtgtggacgccctgctgccaaaaccttcagcaaacagctttccaaatggaagttgtcactgtcarggsctttacaatcagcaacagcaaaatctacatgctgctgagggtcctgcctcattaagatgcaataaatatgtaagtacataaaaacagcaatagaagaaacgtaatgctttattctcaaatatgnatgtctacatagaaaagccaaaattattaagaatagtaaggaatt

SEQ ID NO: 264 - DNA, 2377 bp, Homo sapiens
  SITE (566): n equals a,t,g, or c
  SITE (588): n equals a,t,g, or c
  SITE (902): n equals a,t,g, or c
tcgacccacgcgtccgccgatgtgatgattcctgcgtattccaagaaccgggcctatgccatcttcttcatagtcttcactgtgataggggacgcccccggcgctgtgctatcctgtgccggccacccttgcgttggttttgctgctgtactggtggcgcccctgaccgtggctgtctcctcttgaaggaagcctgtttctgatgaacctgctgacagccatcatctacagtcagttccggggctacctgatgaaatctctccagacctcgctgtttcggaggcgggtgggaacccggctgcctttgaagtcctatcctccatggtgggggagggaggagccttccctcaggcagttggggtgaagccccagaacttgctgcaggtgcttcagaaggtccagctggacagctcccacagacaggccatgatggagaaggtgcgttcctatggcagtgttctgctctcagctgaggagtttcagaagctcttcaacgagcttgacagaagtgtggttaaagagcacccgccgaggcccgagtaccagtctccgtttctgcagagcgncccagttcctcttcggccactnactactttgactacctggggaacctcatcgccctggcaaacctggtgtccatttgcgtgttcctggtgctggatgcagatgttgctgcctgctgagcgtgatgacttcatcctggggggtctcaactgcgtcttcattgtgtactacctgttggagatgctggctcaaggtcttttgccctggggcctgcgarggtacykktcctaaccccarcaamgtgttttgaacgggctcctcamcgtttgtcctggctggwwkkgsmgatctcaactctggctgtgtaccgattgccacacccaggctggaggccgganatggtgggcctgctgtcgctgtgggacatgacccgcatactgaacatgctcatcgtgttccgcttcctgcgtatcatccccagcatgaagccgatggccgtggtggccagtaccgtcctgggcctggtgcaaaacatgcgtgcgtttggcgggatcctggtggtggtctactacgtatttgccatcattgggatcaacttgtttagaggcgtcattgtggctcttcctggaaacagcagcctggcccctgccaataggtcggcgccctgtgggagcttcgagcagctggagtactgggccaacaacttcgatgactttgcggctgccctggtcactctgtggaacttgatggtggtgaacaactggcaggtgtttctggatgcatatcggcgctactaaggcccgtggtccaagatctattttgtattgtggtggctggtgtcgtctgtcatctgggtcaacctgtttctggccctgattctggagaacttccttcacaagtgggacccccgcagccacctgcagccccttgctgggaccccagaggccacctaccagatgactgtggagctcctgttcagggatattctggaggagcccggggaggatgagctcacagagaggctgagccagcacccgcacctgtggctgtgcaggtgacgtccgggtctgccatcccagcaggggcggcaggagagagaggctggcataacacaggtgcccatcatggaagaggcggccatgctgtggccagccaggcaggaagagacctttcctctgacggaccactaagctggggacaggaaccaagtcctttgcgtgtggcccaacaaccatttacagaacagctgctggtgcttcagggaggcgccgtgccctccgctttcttttatagctgcttcagtgagaattcccttgtcgactccacagggacctttcagacaaaaatgcaagaagcagcggcctcccctgtcccctgcagcttccgtggtgcctttgctgccggcagcccttggggaccacaggcctgaccagggcctgcacaggttaaccgtcagacttccggggcattcagctgggaatgatactaatacctccgattttagcccagcaccacagggtacgttccagtttttatttctttccatagctgtaaggccctttctgggaatggttatcattctccttaatctattattgggtcagttttcctgcatgtccccagcctcccatcactgccacccactccccacagagatgccctgctcatccgactggggctttgactcccacactgtgtacccctcttgtgtggacgccctgctgccaaaaccttcagcaaacagctttccaaatggaagttgtcactgtcagggcctttacaatcagcaacagcaaaatctacatgctgctgagggtcctgcctcattaagatgcaataaatatgtaagtacataaaaaaaaaaaaaaaaaaa

SEQ ID NO: 265 - DNA, 1193 bp, Homo sapiens
  SITE (5): n equals a,t,g, or c
tctgntcgccgtcgccccgcccctggcctttgcccggtcgggcgggacttcctgtgtcgtatttccaaggactccaaagcgaggccggggactgaaggtgtgggtgtcgagccctctggcagagggttaacctgggtcaaatgcacggattctcacctcgtacagttacgctctcccgcggcacgtccgcgaggmyttgaagtcctgagcgctcaagtttgtccgtagtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagacacagtgaacactagtctgaatgtataccgaaataaagatgccttaagccattttgtaattgcaggagctgtcacgggaagtctttttaggataaacgtaggcctgcgtggctggtggctggtggcataattggagccttgctgggcactcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttaaatttaaatacatacttatgtttgtattaatctatcaatatatgcatacatgaatatatccacccacctagattttaagcagtaaataaaacatttcgcaaaagattaaagttgaattttacagttaaaaaaaaaaaaaaaaaaaaaaaa

SEQ ID NO: 266 - DNA, 1262 bp, Homo sapiens
  SITE (1203): n equals a,t,g, or c
  SITE (1242): n equals a,t,g, or c
gaaaaacccaaagatgcagacaatctctttgaacatgaattgggggctctcaatatggctgcattactacgaaaagaagaaagagcaagtcttcttagtaatcttggcccatgttgtaaggcgttgtgcttcagacgggattctgcaattcgaaagcagcttgttaaaaatgagaagggcaccataaaacaagcttacacgagtsctccaatggtagacaatgaattacttcgattgagtcttcggttatttaagcggaagactacttgccatgctccaggacatgaaaagactgaagataataaactttcacagtccagtatccaacaggaactgtgtgtgtcttaagaccgaagttcaatatggtatttttggtactgtcttccttcagcagtgcatattcttttgcaaagttctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttccttgttttagatttactttgctcttcgttaatcttattcctgatgatctagaacattagtcatcaacattacatgtttcatgcttcagatattttactgcttgtgtccttattgttggacagctttaaacagagttgatggtacttcaaatatagctcattgatacttaagggcancttccttgggatgtgggctttttggaaggaaaaaaattnccccaaaggcaaatcccagt

SEQ ID NO: 267 - DNA, 1179 bp, Homo sapiens
  SITE (18): n equals a,t,g, or c
  SITE (69): n equals a,t,g, or c
ggcaaactttcccccaangcttcgaaacttgcaagccgaaaccttgaatcgttaaaagttgggttgcgncggcgccctggcccgaagaagcgcaattggcgttccgcgaacgttggccctcaacggctcggcagccagccatgtcctgcacccaggacagcggccctgggctacaaggacctggacctcatcttcctgcgccgacctgcgcggggaaggggagtttcagactgtgaaggacgtcgtgctggactgcctgttggacttcttacccgagggggtgaacaaagagaagatcacaccactcacgctcaaggaagcttatgtgcagaaaatggttaaagtgtgcaatgactctgaccgatggagtcttatatccctgtcaaacaacagtggcaaaaatgtggaactgaaatttgtggattccctccggaggcagtttgaattcagtgtagattcttttcaaatcaaattagactctcttctgctcttttatgaatgttcagagaacccaatgactgagacatttcaccccacaataatcggggagagcgtctatggcgatttccaggaagcctttgatcacctttgtaacaagatcattgccaccaggaacccagaggaaatccgagggggaggcctgcttaagtactgcaacctcttggtgaggggctttaggcccgcctctgatgaaatcaagacccttcaaaggtatatgtgttccaggtttttcatcgacttctcagacattggagagcagcagagaaaactggagtcctatttgcagaaccactttgtgggattggaagaccgcaagtatgagtatctcatgacccttcatggagtggtaaatgagagcacagtgtgcctgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagagaaaaaaaaaaaaaaaaaaaaaaaaaaaaaagagc

SEQ ID NO: 268 - DNA, 1162 bp, Homo sapiens
  SITE (18): n equals a,t,g, or c
  SITE (69): n equals a,t,g, or c
  SITE (1151): n equals a,t,g, or c
  SITE (1154): n equals a,t,g, or c
ggcaaactttcccccaangcttcgaaacttgcaagccgaaaccttgaatcgttaaaagttgggttgcgncggcgccctggcccgaagaagcgcaattggcgttccgcgaacgttggccctcaacggctcggcagccagccatgtcctgcacccaggacagcggccctgggctacaaggacctggacctcatcttcctgcgccgacctgcgcggggaaggggagtttcagactgtgaaggacgtcgtgctggactgcctgttggacttcttacccgagggggtgaacaaagagaagatcacaccactcacgctcaaggaagcttatgtgcagaaaatggttaaagtgtgcaatgactctgaccgatggagtcttatatccctgtcaaacaacagtggcaaaaatgtggaactgaaatttgtggattccctccggaggcagtttgaattcagtgtagattcttttcaaatcaaattagactctcttctgctcttttatgaatgttcagagaacccaatgactgagacatttcaccccacaataatcggggagagcgtctatggcgatttccaggaagcctttgatcacctttgtaacaagatcattgccaccaggaacccagaggaaatccgagggggaggcctgcttaagtactgcaacctcttggtgaggggctttaggcccgcctctgatgaaatcaagacccttcaaaggtatatgtgttccaggtttttcatcgacttctcagacattggagagcagcagagaaaactggagtcctatttgcagaaccactttgtgggattggaagaccgcaagtatgagtatctcatgacccttcatggagtggtaaatgagagcacagtgtgcctgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagagaaaaanaangaaaagag

SEQ ID NO: 269 - DNA, 735 bp, Homo sapiens
cgggctgggtatttgcctcgcaccatggcgcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggccttgggctttagtctggcagtgtatggggccagctaccactctatgagctcgatggcacgagcagcgttcttctgaggatggggccctgatggatggtggcacgagctcaacatggagcagggcatggcagagcaccttaaggatgtgatcctactgacagccatcgtgcaggtgctcagctgcttctctctctatgtctggtccttctggcttctggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaataaatggcttagaatgtgaaaaaaaaaaaaaaaaaaaatttt

SEQ ID NO: 270 - DNA, 783 bp, Homo sapiens
  SITE (654): n equals a,t,g, or c
aagtgcatgagctgccgatgtggtgcttagtgattgcggtttcggtcgctctcccgtgtttcccgggctgggtatttgcctcgcaccatggcgcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggcctgggctttagtctggcagtgtatggggccagctaccactctatgagctcgatggcacgagcagcgttctctgaggatggggccctgatggatggtggcatggacctcaacatggagcagggcatggcagagtgagtgtcccccaccgccagcccaggcaccttaaggatgtgatcctactgacagccatcgtgcaggtgctcagctgcttctctctctatgtctggtccttctggcttctggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacgatttkgcsacnrgccactggccctgggtggctctgtcagggtgcacagcccctcatgcctggagcaatgagggtctagtccaggggccaaaagcagtctgaggtattgggtatacttatactctatagggtcgttgaata

SEQ ID NO: 271 - DNA, 1638 bp, Homo sapiens
  SITE (51): n equals a,t,g, or c
  SITE (92): n equals a,t,g, or c
ggcacgaggcggcggcagcggtggcggcggcgccccccggcgggagccgtnccctttcccgtcggggagcgcggggycggggyccaggggancccgggmcacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagggtaaaccagacttgaatacaacattgccaattagacaaacagcatcaattttcaaacaaccggtaaccaaagtcacaaatcatcctagtaataaagtgaaatcagacccacaacgaatgaatgaacagccacgtcagcttttctgggagaagaggctacaaggacttagtgcatcagatgtaacagaacaaattataaaaaccatggaactacccaaaggtcttcaaggagttggtccaggtagcaatgatgagacccttttatctgctgttgccagtgctttgcacacaagctctgcgccaatcacagggcaagtctccgctgctgtggaaaagaaccctgctgtttggcttaacacatctcaacccctctgcaaagcttttattgtcacagatgaagacatcaggaaacaggaagagcgagtacagcaagtacgcaagaaattggaagaagcactgatggcagacatcttgtcgcgagctgctgatacagaagagatggatattgaaatggacagtggagatgaagcctaagaatatgatcaggtaactttcgaccgactttccccaagagaaaattcctagaaattgaacaaaaatgtttccactggcttttgcctgtaagaaaaaaaatgtacccgagcacatagagctttttaatagcactaaccaatgcctttttagatgtatttttgatgtatatatctattattcaaaaaatcatgtttattttgagtcctaggacttaaaattagtcttttgtaatatcaagcaggaccctaagatgaagctgagcttttgatgccaggtgcaatctactggaaatgtagcacttacgtaaaacatttgtttcccccacagttttaataagaacagatcaggaattctaaataaatttcccagttaaagattattgtgacttcactgtatataaacatatttttatactttattgaaaggggacacctgtacattcttccatcrtcactgtaaagacaaataaatgattatattcacagactgattggaattctttctgttgaaaagcacacacaataaagaacccctcgttagccttcctctgatttacattcaactctgatcccggggccttaggtttgacatgggaggtgggaggaagatagcgcatatatttgcagtatgaactattgcctctgggacgttgtgaggaattgtgctttcaccagaatttctaaggatttctggcttaaatatcacctagcctgtggtaattttttttccct

SEQ ID NO: 272 - DNA, 1455 bp, Homo sapiens
cgtgcgtactgccatgcaggtaccgggtccggaattcccagggtcgacccacgcgtccgctcagttggcaaggtacctgggaaatactgttgatctcagcagttttgacttcagaactggaaagatgatgcctagtaaattacagaagaacaaacagagactgcgaaacgatcctctcaatcaaaataagggtaaaccagacttgaatacaacattgccaattagacaaacagcatcaattttcaaacaaccggtaaccaaagtcacaaatcatcctagtaataaagtgaaatcagacccacaacgaatgaatgaacagccacgtcagcttttctgggagaagaggctacaaggacttagtgcatcagatgtaacagaacaaattataaaaaccatggaactacccaaaggtcttcaaggagttggtccaggtagcaatgatgagacccttttatctgctgttgccagtgctttgcacacaagctctgcgccaatcacagggcaagtctccgctgctgtggaaaagaaccctgctgtttggcttaacacatctcaacccctctgcaaagcttttattgtcacagatgaagacatcaggaaacaggaagagcgagtacagcaagtacgcaagaaattggaagaagcactgatggcagacatcttgtcgcgagctgctgatacagaagagatggatattgaaatggacagtggagatgaagcctaagaatatgatcaggtaactttcgaccgactttccccaagagaaaattcctagaaattgaacaaaaatgtttccactggcttttgcctgtaagaaaaaaaatgtacccgagcacatagagctttttaatagcactaaccaatgcctttttagatgtatttttgatgtatatatctattattcaaaaaatcatgtttattttgagtcctaggacttaaaattagtcttttgtaatatcaagcaggaccctaagatgaagctgagcttttgatgccaggtgcaatctactggaaatgtagcacttacgtaaaacatttgtttcccccacagttttaataagaacagatcaggaattctaaataaatttcccagttaaagattattgtgacttcactgtatataaacatatttttatactttattgaaaggggacacctgtacattcttccatcrtcactgtaaagacaaataaatgattatattcacagactgattggaattctttctgttgaaaagcacacacaataaagaacccctcgttagccttcctctgatttacattcaactctgatcccggggccttaggtttgacatgggaggtgggaggaagatagcgcatatatttgcagtatgaactattgcctctgggacgttgtgaggaattgtgctttcaccagaatttctaaggatttctggcttaaatatcacctagcctgtggtaattttttttccct

SEQ ID NO: 273 - DNA, 1086 bp, Homo sapiens
  SITE (1073): n equals a,t,g, or c
cgcctgcagtaccggtccggaattcccgggtcgacccacgcgtcgctgacccaggagaagctgcctgtctacatcagcctgggctgcagcgcgctgccgccgcggggccggcagctgaactatgtgctcttcagggcgggcaccgtgttgcattcatctttgtacccccagcatctagcagtgttggcatgtagtaggcactcaagaaatgtgtgttgaatgaacgatgcctgtgacaagcaagcggactttattctttcctgacccttgctcctatgacacacctcctcctgactgccactgtcactccttcagagcagaactcctctagggaacctggatgggaaacagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagargcaataaatttttgktttcnaaatggcttgatg

SEQ ID NO: 274 - DNA, 1003 bp, Homo sapiens
ggcacgggagcagccgggctggtcctgctgcgagccggcggcccggagtggggcggcggagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaaagcaaggctcctaactcattgggaacaactggactatggagtacagtttacatcttcacggaagtttttcacaatttctccaataattctatattttctggcaagtttctatacgaagtatgatccaactcacttcatcctaaacacagcttctctcctgagtgtactaattcccaaaatgccacaactacatggtgttcggatctttggaattaataagtattgaaatgttttgaaactgaaaaaaaattttacagctactgaatttcttataaggaaggagtggttagtaaactgcactgtttctctgataatgtgaaatgagaagtatttacattggagggccaatggctggtccttcaagtgctgttttgaagtgcagatttccattaaatgatgcctctgtttaatacacctggtacatttctgaagaggggctttataagcaggctgggcaggcccagcttataagttaaagggcatcacagtgagggtgtagtagataaattcaaggaaataagagatttgtaagaaactaggaccagcttaacttataatgaatgggcattgtgttaagaaaagaacatttccagtcattcagctgtggttatttaaagcagacttacatgtaaaccggaatcctctctatacaagtttattaaagattatttttattaccgtaaaaaaaaaaaaaaaaaaa

SEQ ID NO: 275 - DNA, 1234 bp, Homo sapiens
  SITE (1219): n equals a,t,g, or c
atcagcatctacaagtagcatattttggatggtgtttgtgtgctacttcaaagtaactaggaaaaaataatcctcgcaacacaggtaccttgtcatgtcagaattgggggtgttaggttgccagttgtatcagtgttgattcatttcattacttcctacagagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattctatattttctggcaagtttctatacgaagtatgatccaactcacttcatcctaaacacagcttctctcctgagtgtactaattcccaaaatgccacaactacatggtgttcggatctttggaattaataagtattgaaatgttttgaaactgaaaaaaaattttacagctactgaatttcttataaggaaggagtggttagtaaactgcactgtttctstgataatgtgaaatgagaagtatttacattggagggccaatggctggtccttcaagtgctgttttgaagtgcagatttccattaaatgatgcctctgtttaatacacctggtacatttctgaagaggggctttataagcargctgggcaggcccagcttataagttaaagggcatcacagtgagggtgtagtagataaattcaaggaaataagagatttgtaagaaactaggaccagcttaacttataatgaatgggcattgtgttaagaaaagaacatttccagtcattcagctgtggttatttaaagcagacttacatgtaaaccggaatcctctctatacaagtttattaaagattatttttattaccrtacatatttckcttgttttatgtaagyggatgtatatcctcttgttttatacaagccagttcccacttatgagggtacttttttggttttgctgggcttaatattgtgtattggtcaatgaggccatttttacanttattaacgttacag

SEQ ID NO: 276 - DNA, 574 bp, Homo sapiens
  SITE (1): n equals a,t,g, or c
ngaggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgctacctggtactgctttcagtgtgttccccctcagccctccggcgtgtcaggcatactctgagtagataatttgtcatgcagcgcatgcaatcagaatctcactgagccacccatcattgtgaaataattacctcagttgtacaggacttggtgatcaggatccaggcactcacttgtattctactgctcaataaacgtttattaaact

SEQ ID NO: 277 - DNA, 1731 bp, Homo sapiens
  SITE (492): n equals a,t,g, or c
  SITE (515): n equals a,t,g, or c
  SITE (1676): n equals a,t,g, or c
gctgcaaggtgcgcctcgtgccgctgcagatccagctcactaccctgggaaatcttacaccttcaagcactgtgtttttctgctgtgatatgcaggaaaggttcagaccagccatcaagtattttggggatattattagcgtgggacagagattgttgcaaggggcccggattttaggaattcctgttattgtaacagaacaataccctaaaggtcttgggagcacggttcaagaaattgatttaacaggtgtaaaactggtacttccaaagaccaagttttcaatggtattaccagaagtagaagcggcattagcagagattcccggagtcaggagtgttgtattatttggagtagaaactcatgtgtgcatccaacaaactgccctggagctagttggccgaggagtcgaggttcacattgttgctgatgccacctcatcaagaagcatgatggacaggatgtttgccctcgagcgtctcgctcrarccngggatcatagtgaccacgagtgnaggctgttctgcttcagctggtagctgataaggaccatccaaaattcaaggaaattcagaatctaattaaggcgagtgctccagagtcgggtctgctttccaaagtataggacatttgaagaactggtatgctactcactggtgaaggacagtcaggtgaaggactgtaagcccacacaagctcttcttatctctactagaattaaaatgttaagtcaaaaacggctccttttttgcgcctcctagtgaacttaaccagctagaccatttgagtaccagcatttagttacaaacgtcaaaggcttccggtgctgcttaccttccttttttgttaatgtgcttttatttattaaaaaaaattacaatgaagatgcctgttttgtctctactgtgtactctgatcgtatctttccaaagtgcagactcttgtgaagttttcttaaattgttcactttaaagaaaatgacgtaccaacaatgatttggcttttatattactgtaagatgttataatgttaatgtggatgtagtgcttttactttacagattgattggaataagattattgcatatgaatttacccacaggactctgaatcatgttacccactcccctcacaatgttgtccacttagtgagttgcattgatctatccgtaccaaatgatgttgaataattacatatctttctkgactatactgatttcttattttggtcactattactaaatctctgttaatattctctcttttaactgaaaagggatgggatagaagggtttgcaatgccatattattggtggagggctgttttaacatctttgaagtatggcttgctgaatatctttaccaacatcttgaatatatattctagtgtccacaagatttagcaaaaagataaagcttgggtggaatatcattttaaaatgttcatgttctgttctatattttcttcacctactctccaaatattgtaatgcaaaaagtctcagtaatgatttggtagtattaattttgtggtcattgtttctcttcgataaatttattttcattaaatacttrttagagggttttgaaatgtttttcaaatatgtgaaatgtgaaactgctgtcttttatattaaagtaattaaagaaaatgtattgtgattgaaattattttgncctccacaagatggctctatgagtattcttccagggattctaatatttatttaag

SEQ ID NO: 278 - DNA, 1320 bp, Homo sapiens
  SITE (743): n equals a,t,g, or c
  SITE (1275): n equals a,t,g, or c
  SITE (1303): n equals a,t,g, or c
  SITE (1316): n equals a,t,g, or c
ctgcttaggaagagaaggtcagagttcgcgggggcagaggcattcttgccgctggcccagtcactatgtagtggaggggcagacaccctcccgcaaattctggaaggttcttagtctcgactagggcagtagcccaggactcctagtcgccggcttcaggtcactgccggctgaacggagctgccgtcgccatgtttggctgcttggtggcggggaggctggtgcaaacagctgcacagcaagtggcagaggataaatttgtttttgacttacctgattatgaaagtatcaaccatgttgtggtttttatgctgggaacaatcccatttcctgagggaatgggaggatctgtctacttttcttatcctgattcaaatggaatgccagtatggmaactcctaggatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgcaaatggtatgaggcatnttctgtctccaatattaaggctttttataactgaatatctattttgtctatgaatatattccttttttgacatttaaacatattcttttattgtgaacatcagcactgcatgccattaaagtatgtactatagagatctgatgagaaacagttcttaccctaaatattttgttatattgtcgccattatgaatttataaagacaggaaaatatagttgcctatgttttagggaccactattaaagcttataaatatttgtgtattttcatttagaagtaccatctatgagagtagtttatactgcactgtgtacatgaatggctaatgaatctattttccaactttcccgtgttttatagatatttcttttcactttgagtatcctagagatgggaggatgcctaggaagagtttgttgagaagtggtaccatggtgtagcatgggagagcattgggaatgcactaggtttgaatttggcataatggtagctatgtgaccctgagcaaatttctctcatctgctcatctgangaatgaggaaataggagtgaatttgatntttcctaggtccntcta

SEQ ID NO: 279 - DNA, 515 bp, Homo sapiens
  SITE (465): n equals a,t,g, or c
  SITE (467): n equals a,t,g, or c
ccctggagaggggctgctgtgccagcttggggagggtctgggatggggctgcccctgatggccctgatgtggagtaccttgccagcatctgctggggtgaactttattttagcccttcccttgttgytcttatgaagaacagaggaggggtgggcaggtcagtgatgtcagcagtgagtattcccagcacagcggctctggaagaggcatgaggcatttctttcaggaaatgrtcattattcagccagaaggcattcattaagtaagtcctgactttgtgcccagctctgtgttataggcccttggcgagactcaggaggggcaraggacgctagkttktagwtaacacggaacctcaraggwtatatggtccaagaagacccgggggcggtgaaaaccctgtggactaatgctcacgggagcccgaggtcacactttgactttgctaccatgggctgtgtctangnacgtatatatgctgcgtaattattacagaggcagtccatgtgcattgt

SEQ ID NO: 280 - DNA, 2995 bp, Homo sapiens
tgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggttcttcctcggcaatcagtttggggattctcagcagttgcggctggtccgtattctgcgcaaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaattagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcattgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatggatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaaaaaaaaaaaaaaaaaaaaaaaaaaaaaactcgaggggggcccggtac

SEQ ID NO: 281 - DNA, 1990 bp, Homo sapiens
  SITE (45): n equals a,t,g, or c
gggacccgcgcgsctcccggggatggtgagcaaggcgctgctgcnwcgtgtctgccgtcaaccgcagaggatgaagctgctgctgggcatcgccttgctggcctacgtcgcctctgtttggggcaacttcgttaatatgaggtctatccaggaaaatggtgaactaaaaattgaaagcaagattgaagagatggttgaaccactaagagagaaaatcagagatttagaaaaaagctttacccagaaatacccaccagtaaagtttttatcagaaaaggatcggaaaagaattttgawtaacaggaggcgcagkgttcgtgggctcccatctkaactgacaaactcatgatggacggccacgaggtgaccgtggtggacaatttcttcacgggcaggaagagaaacgtggagcactggatcggacatgagaacttcgagttgattaaccacgacgtgtgggagcccctctacatcgaggttgaccagatataccatctggcatctccagcctcccctccaaactacatgtataatcctatcaagacattaaagaccaatacgattgggacattaaacatgttggggctggcaaaacgagtcggtgcccgtctgctcctggcctccacatcggaggtgtatggagatcctgaagtccaccctcaaagtgaggattactggggccacgtgaatccaataggacctcgggcctgctacgatgaaggcaaacgtgttgcagagaccatgtgctatgcctacatgaagcaggaaggcgtggaagtgcgagtggccagaatcttcaacacctttgggccacgcatgcacatgaacgatgggcgagtagtcagcaacttcatcctgcaggcgctccagggggagccactcacggtatacggatccgggtctcagacaagggcgttccagtacgtcagcgatctagtgaatggcctcgtggctctcatgaacagcaacgtcagcagcccggtcaacctggggaacccagaagaacacacaatcctagaatttgctcagttaattaaaaaccttgttggtagcggaagtgaaattcagtttctctccgaagcccaggatgacccacagaaaagaaaaccagacatcaaaaaagcaaagctgatgctggggtgggagcccgtggtcccgctggaggaaggtttaaacaaagcaattcactacttccgtaaagaactcgagtaccaggcaaataatcagtacatccccaaaccaaagcctgccagaataaagaaaggacggactcgccacagctgaactcctcacttttaggacacaagactaccattgtacacttgatgggatgtatttttggcttttttttgttgtcgtttaaagaaagactttaacaggtgtcatgaagaacaaactggaatttcattctgaagcttgctttaatgaaatggatgtgcctaaaagctcccctcaaaaaactgcagattttgccttgcactttttgaatctctctttttatgtaaaatagcgtagatgcatctctgcgtattttcaagtttttttatcttgctgtgagagcatatgttgtgactgtcgttgacagttttatttactggtttctttgtgaagctgaaaaggaacattaagcgggacaaaaaatgccgattttatttataaaagtgggtacttaataaatgagtcgttatactatgcataaagaaaaaycctagcagtattgtcaggtggtggtgcgccggcattgattttagggcagataaaagaattctgtgtgagagctttatgtttctcttttaattcagagtttttccaaggtctacttttgagttgcaaacttgactttgaaatattcctgttggtcatgatcaaggatatttgaaatcactactgtgttttgctgcgtatctggggcgggggcaggttggggggcacaaagttaacatattcttggttaaccatggttaaatatgctattttaataaaatattga

SEQ ID NO: 282 - DNA, 2436 bp, Homo sapiens
  SITE (24): n equals a,t,g, or c
  SITE (36): n equals a,t,g, or c
aacttcgcttagctctccagggtnaaacgggtgagnccttaaaaacagaagagaacaagatttaaagtccgttgcattgaaaataacaaacaatatcaatgttttaatcaaggatctcttccacattcctccttcttataagagcacagtaacactatcctggaaacctgtacaaaaggttgagattgggcaaaagagagccagtgaagatacaacttcaggttcaccacccaagaaatcttcagcaggaccaaaaagagatgccaggcagatttataaccctcccagtgggaaatatagcagcaatttgggcaactttaattatgagcagagaggagccttcaggggaagtagaggtggccgaggttggggcacacgaggaaatcgtagtcggggaagactctactgaataagacatcagcattcttcagcattgtcatgagcttaatatacttaaattctactactcattggattgccggggatgtccctttaaacagactgctgccttcagctaaaaacttaatgttctttatacctttgtatgtatgacctacttttgtaacagaccatggttgtgtccaaggtaaaaccacagtgatatttttggatgctttgtctgcaatcttgacttgtttttgcagtatcattattcagacttcaaattgtgaatcttttaaacatcttgataatttgttgttgagagctgttcattctaaaatgtaatgaaattcagtctagttctgctgataaagatcatcagttttgaaaggttactgattttcctcttccctcttagttttttacccaatatatggagaagagtaatggtcaatcttaacattttgttttaattgtttaataaagctgctgggcagtggtgcagcattcctacctagtgtcataaaagcaaaatacttacatagctttcttaaaatataggaatgacattacatttttaggagaaagtaagttgctttgcaccgcctacttaattcttttccatatattgtgatacaaacttttgaatatggaatcttactatttgaatagaaatgtgtatgtataatatacatacatacataagcatatatgtgtgtgtgtgtgtgtatatatatatatatgcatgctgtgaaacttgactacacaacataaatcactttttaaattccaggaacgggtagtctgacacggtgattatccttttgaggctgaatccgttattaacttgttatttaggtttttactcccagtagcaagggattctaagttagttgcacttacatgattattgttatttaaaactaagaataaaggctgcattttcaaagataaattggaattgctgttggtgaaataacaaccaaaatactgaatctgatgtacatacaggtttctacaggaagagatggtataatttacaatttggagatttaataaccagggctacccagaaaaagtgacttgataacatggtaccaataagtaagggatgctctctcggtttgcttttgccactttcaagattttaacttctcaggttattaatcaaaattattgtataagttagccaatagaatttttaggttaaaacaacagatggggggtttgtggagtgtttaatgtcatgggcatttttagtagcatagaccctttgttctgcatttgaatgtttcgtatatttttgtttcacagttaatcttccctccccaagtttgctattcaaatcaactgcctgaatgacatttctagtagtctgatgtatttttctgaggaatagtttgtgattccaatgcaggtgtcttcattaccattacctctacactgcagaagaagcaaaactcctttattagaattactgcacatgtgtatggggaaaatagttctgaaaggctagaatgatacaagtgagcaaaagttggtcagcttggctatggagtggtggcaataatctctaaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgtctttataagcatatttgtaaactcagaactgagcagaagtgactttactttctcaagtttgatactgagttgactgttcccttatccctcacccttccccttccctttcctaaggcaatagtgcacaacttaggttatttttgcttccgaatttgaatgaaaaacttaatgccatggatttttttcttttgcaagacacctgtttatcatcttgtttaaatgtaaatgtccccttatgcttttgaaataaatttccttttgtaattttaaaaaaaa

SEQ ID NO: 283 - DNA, 782 bp, Homo sapiens
  SITE (228): n equals a,t,g, or c
gccactgacttctcccacccttctgtctcccccataatagtttatttggttggtctggactcacttgtggcctttrattaaattcctaaggggcctgaagaagacatttctactgcagagggttagaggcacttgagcaaggcccccacatcccaactctgggagttgtggtgggaggaggcacttctgggggataggaccagacaagataacaggagctcacatggnaagcagaagctgtgacaagtttagtagtcccaaaatgggttatatcccttccccctttacatcagaatcttgtgaaatgggaaaacaacagaaggaggggatcaaagatagctgatctcacatgcttcccaggcagggcaraggtgggagtcaaacccgggtgacaggtgggtggagagccctgtttgaggttgtggctgatccctctctggtattagtttttcccctgggagcaggaagccctaggaagaggggactgcagggtccccrggggatctttcctccctcccctgcatgaggcagaggcaagctgcctgccaaccccctccctcaaggaatggccttgcccaggaatgcccaccacacataccctcttctttttttctagtcaaactcttgtttattccttggcttgcctccctccttcctcccctctcaacctttacttctgatttctatttcatggaatttgggattgaagttaaactacaacagtgccgccaacaccaagtcttgcaggaaaaaaatacaaagaaatttaacaaaaaaaaaaa

SEQ ID NO: 284 - DNA, 961 bp, Homo sapiens
gagttccggctggagacccgtgctctgggccggcgccttcaccatggcctcggcagagctggactacaccatcgagatcccggatcagccctgctggagccagaagaacagccccagcccaggtgggaaggaggcagaaactcggcagcctgtggtgattctyttgggctggggtggctgcaaggacaagaaccttgccaagtacagtgccatctaccacaaaaggggctgcatcgtaatccgatacacagccccgtggcacatggtcttcttctccgagtcactgggtatcccttcacttcgtgttttggcccagaagctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtaggggctctgcgggccctggcagccatcctggagcgccgggccgccatgctgcgcctgttgctgctggtggcctttgccctggtggtcgtcctgttccacgtcctgcttgctcccatcacagccctcttccacacccacttctatgacaggctacaggacgcgggctctcgctggcccgagctctacctctaytcgagggctgacgaagtagtcctggccagagacatagaacgcatggtggaggcacgcctggcacgccgggtcctggcgcgttctgtggatttcgtgtcatctgcacacgtcagccacctccgtgactaccctacttactacacaagcctctgtgtcgacttcatgcgcaactgcgtccgctgctgaggccattgctccatctcamctctgctccagaaataaatgcctgacamctccccacaaaaaaaaaaaaaaaaaaactcgaggggg

SEQ ID NO: 285 - DNA, 1228 bp, Homo sapiens
  SITE (1224): n equals a,t,g, or c
cgcgctttgcagttcggtctcctggtgtacggccaacgccaagtaggggattgcgttccctccagtcgcagccctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatgtacttttctggaactagtttttaaattttagattatatgtccacctatcktaagtgtacagttaataattagcttattcaatgattgcatgatgccttacagttttcaataactttttttcttatgcaaacgtcatgcaataaaacaaactctaatgtttggcaaaaaaaaaaaaaaaaaantcga

SEQ ID NO: 286 - DNA, 1327 bp, Homo sapiens
  SITE (791): n equals a,t,g, or c
  SITE (878): n equals a,t,g, or c
  SITE (924): n equals a,t,g, or c
tctcgggtctcgggacaggtgagcaccctgatgaaggccacggtcctgatgcggcacctgggcgggtgcaggagatcgtgggcgccctccgcaagggcgscggagaccggttacaggtgatttctgattttracatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctgatacacacatacaacaagaacagctctgtgtgtgagaactgtggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggancgctaacatggactcctatgacatcgtgctggagaaggacgagactctggatgtggtcaacgggctactgcagcacatcctgtgccnagggggtccagctggagatgcaaggcccctgaaggcgcaggctccnaagkccsctgcaggccgtggtgaggaggggcgcctccccagagtctgctcccccgtgaacacagagcagagccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaatttttaaacatgggaagttcaaacaaatataatgtgtgaaacagatcaaaatttttaaaatgaaaaaaaagctgctctgattcaggggatgtgggtcggggtagaacctggacctcttggcctgggggcacatgggatgcttctag

SEQ ID NO: 287 - DNA, 1847 bp, Homo sapiens
cggttgccggagcccgaactgarggcggcggcgggagccggttggbgtctggtcttcgcgtcggccccgcggagccagacgctgcccccggcgcggggagaagatggtgccgagcggcctcgggcccgccacgcgccgccacgagtgagcccagcgcgaccgcgggcgtccgccgagcagctggcccggctgggcccggggcgcgcactgcccgccggggcggggtggagctgatcagaataatgttcagcatcaaccccctggagaacctgaaggtgtacatcagcagtcggcctcccctggtggtcttcatgatcagcgtaaggcccatggccatagctttcctgaccctgggctacttcttcaaaatcaaggagattaaatccccagaaatggcagaggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtcytcaatcaccctaaccctgggacccactgaaacccttcggagggtattcccgcaacgtcacccatctgtactcaaccatcttagggcatcagattggactttcaggcagggaagcccacgaggagataaacatcaccttcaccctgcctacagcgtggagctcagatgactgcgccctccacggtcactgtgagcaggtggtattcacagcctgcatgaccctcacggccagccctggggtgttccccgtcactgtacagccaccgcactgtgttcctgacacgtacagcaacgccacgctctggtacaagatcttcacaactggccagagatgccaacacaaaatacgcccaagattacaatcctttctggtgttataagggggccattgggaaaagtctatcatgctttaaatccccaagctttacagtgattgttccagatgaatgaccgttcattaataaatttgcatctcatgcacaccagttacttcctctttgtgaatggtgataacaatgttttgctatgctgtttatcaagggcagacctagcaaattgcgtcagagcaatcctgaattttgtcccgagaaggtggctttggctgaagcctaattccacagctccttgttttttgagagagactgagagaaccataatccttgcctgctgaacccagcctgggcctggatgctctgtgaatacattatcttgcgatgttgggttattccagccaaagacatttcaagtgcctgtaactgatttgtacatatttataaaaatctattcagaaattggtccaataatgccgtgctttgccctgggtacagccagagcccttcaaccccaccttggacttgaggacctacctgatgggacgtttccacgtgtctctagagaaggattcctggatctagctggtcacgacgatgttttcaccaaggtcacaggagcattgcgtcgctgatggggttgaagtttggtttggttcttgtttcagcccaatatgtagagaacatttgaaacagtctgcacctttgatacggtattgcatttccaaagccaccaatccattttgtggattttatgtgtctgtggcttaataatcatagtaacaacaataatacctttttctccattttgcttgcaggaaacataccttaagttttttttgttttgtttttgtttttttgttttttgttttcctttatgaagaaaaaataaaatagtcacattttaatactactcaaaaaaaaaaaaaaaaaa

SEQ ID NO: 288 - DNA, 799 bp, Homo sapiens
tcaccctgcctacagcgtggagctcagatgactgcgccctccacggtcactgtgagcaggtggtattcacagcctgcatgaccctcacggccagccctggggtgttccccgtcactgtgtggctttggctgaagcctaattccacagctccttgttttttgagagagactgagagaaccataatccttgcctgctgaacccagcctgggcctggatgctctgtgaatacattatcttgcgatgttgggttattccagccaaagacatttcaagtgcctgtaactgatttgtacatatttataaaaatctattcagaaattggtccaataatgcacgtgctttgccctgggtacagccagagcccttcaaccccaccttggacttgaggacctacctgatgggacgtttccacgtgtctctagagaaggattcctggatctagctggtcacgacgatgttttcaccaaggtcacaggagcattgcgtcgctgatggggttgaagtttggtttggttcttgtttcagcccaatatgtagagaacatttgaaacagtctgcacctttgatacggtattgcatttccaaagccaccaatccattttgtggattttatgtgtctgtggcttaataatcatagtaacaacaataatacctttttctccattttgcttgcaggaaacataccttaagttttttttgttttgtttttgtttttttgttttttgttttcctttatgaagaaaaaataaaatagtcacatttttaatacyaaaaaatggacaaaaaaagtcgagggggg

SEQ ID NO: 289 - DNA, 2196 bp, Homo sapiens
aaagactctaacatccatgagcttgaacatgagcaagagcctacttgtgccksccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtggaaaaacaaaacacttaactagaattctctaataaggtttatggtttagcttaaagagcacctttgtatttttattatcagatggggcaacatattgtatgaagcatatgtagcacttcacagcatggttatcatgtaagctgcaggtagaagcaaagctgtaaagtagatttatcacacaatgactgcatacagacttcaaatatgtcaatagtttggtcatagaacctagaagccaaaagccacacagaagggcaagaatcccaatttaactcatgttatcatcattagtgatctgtgttgtagaacatgagggtgtaagccttcagcctggcaagttacatgtagaaagcccacacttgtgaaggttttgttttacaaatcacttgatttaacacactcaggtagaatatttttatttttactgttttatacccagaagttatttctacattgttctacagcaagaatattcataaaagtatccctttcaaatgcctttgagaagaatagaagaaaaaaagtttgtatatattttaaaaaattgttttaaaagtcagtttgcaacatgtctgtaccaagatggtactttgccttaaccgtttatatgcactttcatggagactgcaatacgttgctatgagcactttctttatccttggagtttaatcctttgcttcatctttctacagtatgacataatgatttgctatgttgtaaaatctttgtaaaaaatttctatataaaatatttgaaacttaa

SEQ ID NO: 290 - DNA, 1185 bp, Homo sapiens
gcagttaaggcttctgataaggaaagagagtctgaacagagcacacacatctggagctccaggagtgggggatgcagcatcagattccatcttgaatttctgctaaaatactttgtactcataatggatctcaacaaagatctgtatttcatctgtggctccatcttccctctgggtcaagtagatgttaagctggaccttggcacgcctcttaacatgaagagatctagctagacagacagactcccccatttatgggaacaagaattcaatttattctctatttataaaacatttttttaaagtgccttgggtataaaaatctaaatgtctgcggtgtgatcagtcaggagcacgtaactatcactcttcgcatcctttggtcactgggagatcctttgggggctgggaggtccttctgtcccaggctaaaggaaaagcttcacaagggtaagagccacagaaccctcggcaagaaaggccggtcagggagaatgaatggtacagagaggaaaggaaggaaagggggtggaacagaggtagaaggcaaggaagggatgccgcactggagaccgatggggacactctaattgtgcaagagggaggatcttccttcttgaatgctgaacacagctagtctgaaccttccttggaaagtccagctgtttgcccatgcatagggccaactctccctgcaaagcagcaaatgtggcttctatcaggaaggaaaagtatccatcagtgtgacaagaggtcaccttcgaacttgcatgaactccttgcgcagccacaaagagtcctggtagaagtgaggatcgcctagtcttacggctgtccgtttatagaagtagcagtacaacactgctgctagtctctggaatacaaacagcatttgaagtccatctgtccatatgaagctgttggagtttttccagcgtaagttcatgacccagacatgaagggagatgctgagggcaaagtacacagctgtcaggatgatggtccctttgaacttatggaataggaggttgaccaggccagcctggaagacgaaggtgttgaagaacatgaggaaaatgatgatgatgttgaagaggactgcaatatcctggatgcactgagggagaggyttctagttcctttgaatgagagctgtttcccttgctctaaggcaagcacctccaa

SEQ ID NO: 291 - DNA, 1634 bp, Homo sapiens
agggaaaggggagggtagcgggagggtagcaggtgagttcctagggctggaaggtttagcagcagcctggtgcagtgccctgtcatcaagacaaacccacggtcctmctgggtgcctaccaagcttggtttgtacaaaagcaaggtgggagtctatttttgtacatgagatacatcacacttacctgtgggccagtattgtgaagtgagtctgagttgtttacactgatgccttccctgcccaccacaaattgtgtacatagtcttcagatgataccacccctttccccagctcccaaccaagagctggttctaggcctgtgttatatgtcatatttagcstttttatatatgacctttgatttctgttgtttgtattttagcacagtgtatgcaccttcatttaaatacatctgtgtgcatacagatacgcatatatgtgtgtgcgtatgcatatatctctcatctgtagtttccaagagttcagctgaagcagatggagtcctgcagcccaggagacaccctgcatccctgctaatagtgtttgccacaagtattagtgagtcttccttattaatattttcatttcagaagactgaagcaaagctgatagtgtttgctgtttctttggcagctaagtgagggtcttgggatgacttgctgtgttcctcaagctgcactttggggccatctctgcagtattagccccctttttgcttggtggtactctgtctgtgcctgtgtgtgtgtgtgatagtcactcttgcatggcttccatgtctggtttgtggcatttggggataaggtgctgaagccagagcatttgcagtttgtttgaggcctcgttgccaatgatagatcactcctgttgacctggtatgtctgcttgcttgctgcttttccttgctttctcttggaagaggaaaggactctggtcaggcccaggctgagtgagatgagctgcagctggctcatggccttcttagagcagagagaggagtatgtcattttactaagttcctaaacaaacatttatgcaggcaacactccttgcagatccagaaactgaggcacaatagggttatgacttgctcaagaatatgtagctgctagggggtaaatcaaggcatcacaatttctgttcagcgggcaggaataggctgtgaattgctagcactttttttttttaagcaattactttttgacttgttcctctgaaagtgcaagaggcgtacacctttcccaaatgtagactagaatctgcaggatgccacccactgtatagttctgctttcccagagaggaagaacttttagaaaccaaatgatcttaattgttattgcccacccctggcttttccgggtagaaaattcacagtaggaatgattgttaagagagagtgcttggaaccatgggttaacaggaaaggctacctaacttcacatatctgcaaccagagcagccaccaagcattacttagcagcaggaaaatgattgtatttgagttcctgtgtgtccaaaactgaggcaccatgttctttgaaaacatgccacctcaaggctgggcgcggtggctcacacctgtaatcccagcaytttggggaggccsagggcggggcggkttcaccgggggtc

SEQ ID NO: 292 - DNA, 1795 bp, Homo sapiens
  SITE (445): n equals a,t,g, or c
  SITE (454): n equals a,t,g, or c
ttccccccaggttggcttccttcgattccttttcttggtatcaacgtttgattggaagaacaaccccctctttgtcaacctcaataatgagctcactgtggaggagcagctcgggcacagctcmccgtyatggtcattgttaccccccaagaccgcaaaaactctgtgtggacacaggatggaccctcagcccagatcctgcagcagcttgtggtcctggcagctgaagccctgcccatgttagagaagcagctcatggatccccggggacctggggacatcaggacagtgttccggccgcccttggacatttacgacgtgctgattcgcctgtytcctcgccatatcccgcggcaccgcaggcttgtggactcgccagytgcctccttctgccggggcctgctcagccagccggggccctcatccctgatgcccgtgctgggtnatgatcctnctcagctctatctgacgcagctcagggaggcctttggggatctggcccttttcttctatgaccagcatggtggagaggtgattggtgtcctctggaagcccaccagcttccagccgcagcccttcaaggcctccagcacaaaggggcgcatggtgatgtctcgaggtggggagctagtaatggtgcccaatgttgaagcaatcctggaggactttgctgtgctgggtgaaggcctggtgcagactgtggaggcccgaagtgagaggtggactgtgtgatcccagctctggagcaagctgtagacggacagcaggacattggacctctagagcaagatgtcagtaggatgacctccaccctccttggacatgaatcctccatggagggcctgctggctgaacatgctgaatcatctccaacaaaacccagccccaactttctctctgatgctccagcattggggcaggggcatggtggcccatgtagtctcctgggcctcaccatcccagaagaggagtgggagccagctcagagaaggaactgaacccaggagatccatccacctattagccctgggcctggacctccctgcgatttcccactcctttcttagtcttcttccagaaacagagaaggggatgtgtgcctgggagaggctctgtctccttcctgctgccaggacctgtgcctagacttagcatgcccttcactgcagtgtcaggcctttagatgggacccagcgaaaatgtggcccttctgagtcacatcaccgacactgagcagtggaaaggggctatatgtgtatgaatagaccacattgaaggagcacaatgccctcctgtgttgatgccacttcccagggtggagacagtggaaaagaaccgaggacaggaaaggattgggtaggtgaaggggtcaggggactggtagtcacccaatcttggagaggtgcaaaaagcactgggggctacccgttagctgcatctgccctggctgtttgcccgttcatgtcacaaactgccactactatgtacctgcagtggggttgcagagatgggggagactcaagtcttactccccaggagctcccagggcccaaggaggagaatgctgcctcctttcagtctggtctacacccactttctggtagcctctctgcttcctgtaattctggctgtttttccagactcagctcaaatagtgcccctccttaagcccatccctcgcccccagcctgaggtgatctttccctcctctgaactattagagcagttactgtctgttcagttcgtttggcaggcacacacagtggcataaattctattgttttgaactctgatt

SEQ ID NO: 293 - DNA, 858 bp, Homo sapiens
tctgctttcggtgctgcgtgtactgctgggcggcttcttcgcgctcgtggggttggccaagctctcggaggagatctcggctccagtttcggagcggatgaatgccctgttcgtgcagtttgctgaggtgttcccgctgaaggtatttggctaccagccagatcccctgaactaccaaatagctgtgggctttctggaactgctggctgggttgctgctggtcatgggcccaccgatgctgcaagagatcagtaacttgttcttgattctgctcatgatgggggctatcttcaccttggcagctctgaaagagtcactaagcacctgtatcccagccattgtctgcctggggttcctgctgctgctgaatgtcggccagctcttagcccagactaagaaggtggtcagacccactaggaagaagactctaagtacattcaaggaatcctggaagtagagcatctctgtctctttatgccatgcagctgtcacagcaggaacatggtagaacacagagtctatcatcttgttaccagtataatatccagggtcagccagtgttgaaagagacattttgtctacctggcactgctttctctttttagctttactactcttttgtgaggagtacatgttatgcatattaacattcctcatgtcatatgaaaatacaaaataagcagaaaagaaatttaaatcaaccaaaattctgatgccccaaataaccacttttaatgccttggtgtaagtatacctctgaacttttttctgtgcctttaaacagatatatatttttttttaatgaaaataaaaccatatatcctattttatttcctccttttaaaaccttataaacta

SEQ ID NO: 294 - DNA, 915 bp, Homo sapiens; identical to SEQ ID NO: 157

SEQ ID NO: 295 - DNA, 1517 bp, Homo sapiens
  SITE (35): n equals a,t,g, or c
  SITE (55): n equals a,t,g, or c
  SITE (794): n equals a,t,g, or c
ccttgtggcaactagtgggtcccccgggctgcagnaattcgggcagtggttctgngtctgaagatactctgagttcctctgagagatccaaaggctccgggagcagacccccaacccccaaaagcagccctcagaagaccaggaagagccctcaggtgaccaggggtagccctcagaagaccagctgtagccctcagaagaccaggcagagccctcagacgctgaagcggagccgagtgaccacctcacttgaagctttgcccacaggacagtgctgacagacaagagtgggcgacagtggaagctgaagtccttccagaccagggacaaccagggcattctctatgaagctgcacccacctccaccctcacctgtgactcaggaccacagaagcaaaagttctcactcaaactggatgccaaggatgggcgcttgttcaatgagcagaacttcttccagcgggccgccaagcctctgcaagtcaacaagtggaagaagctgtactcgaccccactgctggccatccctacctgcatgggtttcggtgttcaccaggacaaatacaggttcttggtgttacccagcctggggaggagccttcagtcggccctggatgtcagcccaaagcatgtgctgtgcagagaggtctgtgctgcaggtggcctgccggctgctggatgccctggagttcctccatgagaatgagtatgttcatggaaatgtgacagctgaaaatatctttgtggatccagaggaccagagtcaggtgactttggcaggctatggcttcgcnttccgctattgcccaagtggcaaacacgtggcctacgtggaaggcagcaggagccytcacgagggggaccttgagtttcattagcatggacctgcacaagggatgcgggccctcccgccgcrgygacctccagagcctgggytamtgcatgctgaagtggytctamgggtttctgccatggacaaattgccttccaamamtgaggacatcatgaagcaaaaacagaagttgccttgggattcattttaatgtaagctkgactttgtcatgccagaaacaaggctcggtcaccgtcagcagtttgcagttttccacctccwcccagttcctccgtgtggttgacccagatatctccgttatgcagccgcctccgggggaccacctccctccctttgagtcagccacagacagcctacttgacggccccgctggcccccacattccactgaactgtgcggatgccacagtgaccccctctcaggcacagcatgacctcctgaagtcgagcctgcttgctttgaacctaccagttaaaatctcctcaaaatgtttggataccgcccattggcccctcacagccacgagctccctgaccagtgtgcgtgtgtgtgtgtgtgtgtgtctgtgtgtgtgcttgggacgggtggggaggtcacctttgggtgtgcggtgtgcccccaggacctgtaagtaataaaatctttatttccaaaaaaaaaaaaa

SEQ ID NO: 296 - DNA, 3865 bp, Homo sapiens
  SITE (632): n equals a,t,g, or c
  SITE (1651): n equals a,t,g, or c
  SITE (1826): n equals a,t,g, or c
tggagggggggagcttccttgagcagtgggcccaggcctggccctccacacttcattctctgacctttctctctcctcatttcggtgcatgtcctttctgcagctgcctttcagcacaggtggttccactgggggcagctaacgctgagtgacaaggatgggaagccacaggtgcattttactcaagtcttctctagtcaatgaggggcacccagtgcttctagggcaggctgggtggtggtcccctaggtatcagcctctcttactgtactctccgggaatgttaacctttctattttcagcctgtgccacctgtctaggcaagctggcttccccattggcccctgtgggtccacagcagcgtggctsccccccagggccaccgcttctttcttgatcctctttccttaacagtgacttgggcttgagtctggcaaggaaccttgcttttagcttcaccaccaaggagagaggttgacatgacctccccgccccctcaccaaggctgggaacagaggggatgtggtgagagccaggttcctctggccctctccagggtgttttccactagtcactactgtcttctccttgtagctaatcaatcaatattcttcccttgcctgtgggcagtnggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaaccctgggaatggctggaggtgggagagaacctgacttctctttccctctccctcctccaacattactggaactctatcctgttaggatcttctgagcttgtttccctgctgggtgggacagaggacaaaggagaagggagggtctagaagaggcagcccttctttgtcctctggggtaaatgagcttgacctagagtaaatggagagaccaaaagcctctgatttttaatttccataaaatgttagaagtatatatatacatatatatatttctttaaatttttgagtctttgatatgtctaaaaatccattccctctgccctgaagcctgagtgagacacatgaagaaaactgtgtttcatttaaagatgttaattaaatgattgaaacttggctgtggctactgcttcttaatgttggggggacagggcagtggtctgggcccacatttagaagggaaaatgttttgcctgctgcacacattggacccaagtatgggcctcttctgcctagtactgccaaagggactgttaaggtgtcttgtccatcttctaccccccaccccccattacgggtaaaggraaccccagactaggtgaggggccagcagctgcctcacattgtgttctctcctgagatggtccagctcacatccagacaccttgttcagacattttatttgaatttatgacagtgatggggatttgactgagatgccttatggagaagtaccccaccctctatgaagacagaatcactctctgccattcattctgcctgatgctaacaacacgcagctgatttagggagtgtcccagcctagctggatcaagggaaattccaggagccctggggcaggccctggnccccagtgccaagcctcagagtaagcagacattgggaaagttgccaaccacttggtagaccactaggttctctgttttcccttccctttccttttcaaatcccacagtttcctgttggggagaagctgtaattagcctagtccaggtaccagatcccagctaggggcgcagctgncttggataactccaagaaaacctgggcaccagtatttttccaattataaggactgtggcataaatttttaaatgagttatattgaaaccagatttctccagctgccaagggaagaaggtagggctggactccctgctgtggcccagcccttgttaggggttggtctctcactgcagccagacaggatgatcctgggttctggggagggtaagctgccccttgccgagttctgcaccgaataaagagtccaaacccgctgcttccgtgtcctgagagatgggtaaatgggtgatggatggagcagactgaagagacagcagatgactcagtggtggaagaaggggggaagatgctgggctggctagctaatgttcccccctttcagcgatttacaggaaatggagcccagcttggtcatgaagttggtttgcttccactgtgcgatgcactcctcagaaattttgaagtcagcctgcaacttctcgaagactttcttcttgggcttgagctcctcatctggttggcccttttcatagcccttcacaaacacgtgctcaccaggagcagagcctgccggagggtccagaggttcaactggcggtttatcccttctatagaagcacacagaagcatgccttgggactcgactcctctcatcttctggggtttcaggttgcacagcaccactaccagcctgtcctgcagttcctccttgggcacgaactgtaccaggccgctcaccacagtccgtggttcagcttcccccacgtcaatcttctctacatacaggctgtctgcatctgggtgcttctccacagtgatgattttccccacacggatatccagccgggatgggatgacctcctctggttctgaattcttggcaggcctttggccattggcttctgctttgagggatctgggtaggcagcgctggccagttttttcagggcaggggtattaaacttttcccggattggatccagcaacttgttcagtgcgacttcaacagaattcttcaggtctccaggatgtacaacctcagcagcaaagtccttttccaggtccacgtaagctgtgtaggttttgtttccaccccatttctcatctcgtaggatcacaaactcggacttaaggggaaaaaggacatgcttgatgaaggacagaaccccattgttctccacatttcctggctcacagaaggccttcttcagttttttcttcacatcctccttccgatcaaggagatcaatcttggactcctcttctgaagagctcattttgctgcctgttaatcctggaaccataggattcatcagatggacccgttttgaatagccaagtgcagggaggtacttctctgcaaaggtgaaaatctttctctgatcaatgcctccaaattgggcatctacttttaaatactcttcatccaaagcctgcagtccggggtataagaggccactcagcaaagggtgctccacctgctttaccacctcagctccagccttcttggaatcgtgctgtgtgaccacggaggagagtctgtacacatctagtgtgtactctttgctgagctggtaatcagtgcctttgatgaacttgagcttctccaagggcacaccaatgctctccagcattgctttgatcacattctcatagtaactgactcggagttctagaagttcccatggggctttcatgttatccaggtatgcgtggaggtccgcaaacagaattgttacctcacaccctgcctttaagaagtctgcaatctttgacatgggcacaaagtaagccacatgtggtttgcccgtggttgccgttccccagtaaattttaagttcccgctccttcagtatctccttcagcttctcttcccccagaacctcctgcaggttccgggtgataaggtgcagtttctcttcagggctgggagcgtcccccatggtccgctacccctgcttcccccgctcagcccggcaccagagccccttcctgggtcaccgtcgccgccgcgtgccgggaactgtcacgcgagt

SEQ ID NO: 297 - DNA, 1910 bp, Homo sapiens
  SITE (263): n equals a,t,g, or c
agggagaggaggagagggggtctgcgcgcggccgctacccagaagccagcggacggcagcacggagtgggctgtccccgagcccagccccgagcgagccccccccccgcccccgmaggacgcgcctyccagccagcccgactcctaggaggaggggaggcgggaaagcagctcaagcctcacccaccgccctgcccccagccccgccactcccaggctcctcgggactcggcgggtcctcctgggagtctcggaggggaccgnctgtgcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatcaggtggaagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcggtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttcmtaaaaaaaaaaaaaaaaaaaaggggggggg

SEQ ID NO: 298 - DNA, 3276 bp, Homo sapiens
  SITE (3220): n equals a,t,g, or c
  SITE (3264): n equals a,t,g, or c
  SITE (3265): n equals a,t,g, or c
  SITE (3269): n equals a,t,g, or c
  SITE (3270): n equals a,t,g, or c
gcgaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgattcaaaaggtgatgacctatcaacagccattctcaaacagaagaaccgtcccaatcggttaattgttgatgaagccatcaatgaggacaacagtgtggtgtccttgtcccagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggagacatttttcttgtccgtggtgggatgcgtgctgtggagttcaaagtggtggaaacagatcctagcccttattgcattgttgctccagacacagtgatccactgcgaaggggagcctatcaaacgagaggatgaggaagagtccttgaatgaagtagggtatgatgacattggtggctgcaggaagcagctagctcagataaaggagatggtggaactgcccctgagacatcctgccctctttaaggcaattggtgtgaagcctcctagaggaatcctgctttacggacctcctggaacaggaaagaccctgattgctcgagctgtagcaaatgagactggagccttcttcttcttgatcaatggtcctgagatcatgagcaaattggctggtgagtctgagagcaaccttcgtaaagcctttgaggaggctgagaagaatgctcctgccatcatcttcattgatgagctagatgccatcgctcccaaaagagagaaaactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacagtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcnaaatgggwraaaaaaaaaaaaaaaaaggggggcccctctaaagnnccanncttcgt

SEQ ID NO: 299 - DNA, 1695 bp, Homo sapiens
  SITE (1693): n equals a,t,g, or c
ttgcaatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaagggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataattaaaaaaaaaaaaaaaaanct

SEQ ID NO: 300 - DNA, 1501 bp, Homo sapiens
  SITE (1125): n equals a,t,g, or c
cactttcagcagtcctttgctctctttgcttctacctcaaatagccccaggagtgggctttagtctccaatatggagcatctcaagcttctcctgggggatggggattgggatgggcagaatctgttttggwtctccgggttatttccagtgggtgtaaaagcagagctgggcctttccctctcttatccctgagggtgggtaagaaggactgtatctacacctgttcttccctaccttctcttttgttagggaggcctcattctaagttcctcaagagagtccttggcttaaagctgtagcaagggtgtgctaggtgggggatttggagcaaaaccgtcgagtaggcatgatactggtatggagtgggcctgcaaaatcagacagaaatggcttgagaagccgcaggggagcatgcctgtctctcagtgatagagtatgggagggacctccctagcttggaaaatgagaattgaaggggttatgaacaaataggatgcctagttgaggatgttcccaaagttttgtccaatcttatcattagtagattttataagccacagagacaaaccagaaacggaataatgttactttggatgctttatttttttgttctaggtgtggctttgtacatgcagaagaatgctatatgctgcacattttgcctttaaagtcttacgactttccccattttagtctaatgggaagatacagatgtgcaagtctgcttttttgttttttgttattatttttttttttttgctctgtgttatggacattttcagacatgcacagaagtggagaggatggtccttggacccmatgtgtccatcacctagctgcatcacttatcagctatggtcaacctggtttcatctgtatctctctcttttcacctgtattgtttattgaaaatccaagacactatgccaatgcaaccgtgactactttgggagattggtagtctcttttgatggtgatagtgatggggtgcactatcataatcacatcaggtctgctttttgcttttaatgttaactaatgaagttccagagatgggccttagaaatgtgttttaagaattaacaaggagtctcaaaaagaaatgagagggatgcttcctttncccttgcatctacaaaacmagagagagactgttctgttgtaaaactctttcaaaaattctgatatggtaaggtacttgagacccttcaccagaatgtcaatctttttttctgtgtaacatggaaacttgtgtgaccattagcattgttatcagcttgtactggtctcataactctggttttggaagaataatttggaaattgttgctgtgttctgtgaaaataacctccccaaaataattagtaactggttgttctacttggtaatttgacaccctgttaataacgcaattatttctgtgttcttaaacagtataaatagttgtaagtttgcatgcatgatggaaaaataaaaacctgtatctctgttaaaaaaaa

SEQ ID NO: 301 - DNA, 2683 bp, Homo sapiens
  SITE (4): n equals a,t,g, or c
  SITE (20): n equals a,t,g, or c
  SITE (30): n equals a,t,g, or c
  SITE (817): n equals a,t,g, or c
  SITE (2660): n equals a,t,g, or c
  SITE (2661): n equals a,t,g, or c
tgantgtggtcccgggtgcngattggcagngcctccgccgcggctcgtggttgtcccgccatggcactgtcgcgggggctgccccgggagctggctgaggcggtggccgggggccgggtrctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttnaaactttttaccaagctttttaaagatgacatcaggtatctgttgacaatggacaaactatggcggaaaaggaaacctccakttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggsccaaacaagctgaagatgctgccaaaagcataaccaatgggcagtgatgatggagctcagccctccacctccacagctcaagagcaagatgacgttctcatagttgattcggatgaagaagattcttcaaataatgccgacgtcatgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcaytgcattctkgtkaaaaaaannacagaaaaaaaaaaaaacaaga

SEQ ID NO: 302 - DNA, 1454 bp, Homo sapiens
  SITE (1454): n equals a,t,g, or c
ggactcggggtggctctaaggggcagggatagggctggggagcgccggcctgtggccctgaccagccccttctcgtgcaggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcagccctcaccctcgtyttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggcctgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagaaatgtgaacatgtgtgtgtgttgtgttaattctttctcatgttgggagtgagaatgccgggcccctcagggctgttcggtgtgctgtcagcctcccacaggtggtacagccgtgcacaccagtgtcgtgtctgctgttgtgggaccgttgttaacacgtgacactgtgggtctgactttytcttctacacgtcctttcctgaagtgtcgagtccagtcctttgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgwmaaaaaaaaaaaaaaaaaaaaacn

SEQ ID NO: 303 - DNA, 828 bp, Homo sapiens
  SITE (491): n equals a,t,g, or c
accctggcatgccccacaaacagatcaccagccagcttacacaggcattaactctcctcaatgaggaagaatcattcacaactgagcaagacattcatatgatcatttaaggaagtgtttcccttatgtgttagcaagtataatcggctaactcctaaatcccaatgaatagtcctaggctggacagcaatgggctgcaattaggcagataaagacatcagtcccagtaaatgaatccatagactcatctagcaccaactaccattagcactatgttaggagctgcaaggccccaaagtagaagatgtgcataatgtctgctcttgtgtagctcaggagacaattccagcacagacactacagttaacgctgaactgcagctgcaagtaatagcawgaacagtcagaaaaataccttatgagggggcagggctgaagctgggccttgaaggatggatgaaatttggatagagaatgaggaagacagagggnctccaagtgagagaagcatgaaaaatgagcargggcctggatcagtggggtgtattcagagcacctytccagatgcaccatgcatgctcacagtcccttgcctatgtgtggcagagtgtcccagccagatgtgtgcccccaccccatgtccatttacatgtccttcaatgcccacctcaaaaggyacytcttctgtaaagctttccctkggtatcaggaatcaaaattaatcagggatcttttcacactgctgttttttcctctttggtccttctatcactaaaactcatctcattcagccttacagcataactaattatttgttttcctcactaca

SEQ ID NO: 304 - DNA, 2416 bp, Homo sapiens
tcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagstagggctgcaaarcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagrgrgaamcmccaaaaaaaaaaa

SEQ ID NO: 305 - DNA, 545 bp, Homo sapiens
  SITE (509): n equals a,t,g, or c
  SITE (521): n equals a,t,g, or c
  SITE (541): n equals a,t,g, or c
gaattcggcacgagccatgcytggcctctccttgattcttacagtcactttgttggctgtttctgactcagcagctacctgcattgtggccaaaggatgacctattccttctcaggagggcaaaaatgtggaatagtgtctgtccatgcctctcctcatgggctaccacctctgccaccgtggttaatcagtaacaaccaggagagaagctgctggaactgacctctgggaactccctggatggtttggtgcaggaatgtagtaggcatacacgtggttgcgtggatctgggccctcctgatgtgagtagagaggtaaaaggscaccatctccttgacctytggggaactcatccacaaagaagatgtttccaagatgcttctgaagattgsctaaaaatagccggtttccacccccgtgaatgcatccattctagaatgctccttcaccaggaccagagaactgatttacagaagtgacatgaaaacattccatcccagaatttgcantacctcaaattnaatttctacctattaaaaanaaaa

SEQ ID NO: 306 - DNA, 1530 bp, Homo sapiens
  SITE (608): n equals a,t,g, or c
  SITE (1512): n equals a,t,g, or c
  SITE (1529): n equals a,t,g, or c
ggctctgctgggcatcatacttgtcactgggtaaacagtttgcccacttaccgcagatgaagctgcttgccagggctctccggctctgtgagtttgggaggcaggcatcttccaggaggctggtggctggccagggatgtgtggggccccggcgagggtgctgcgctcccgtccaggtggttgggcccagggctgatctcccaccctgtggagcctgcattactggaaggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcangagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactmataaagctgntgcttggctggggaagna

SEQ ID NO: 307 - DNA, 997 bp, Homo sapiens
  SITE (103): n equals a,t,g, or c
aggtagtgagagacacattacacctaaccaacaagaagaaggatcctcccccttataatttaactatgtttacagggaatgcgtacattgtggcttcccgagnatttcgtccaacatgttttgaagaaccctaaatcccaacaactgattgaatgggtaaaagacacttatagcccagatgaacacctctgggccacccttcagcgtgcacggtggatgcctggctctgttcccaaccaccccaagtacgacatcttcagacatgacttctattgccaggctggtcaagtggcagggtcatgagggagacatcgataagggtgctccttatgctccctgctctggaatccaccagcgggctatctgcgtttatggggctggggacttgaattggatgcttcaaaaccatcacctgttggccaacaagtttgacccaaaggtagatgataatgctcttcagtgcttagaagaatacctacgttataaggccatctatgggactgaactttgagacacactatgagagcgttgctacctgtggggcaagagcatgtacaaacatgctcagaacttgctgggacagtgtgggtgggagaccagggctttgcaattcgtggcatcctttaggataagagggctgmtattagattgtgggtaagtagatcttttgccttgcaaattgctgcctgggtgratgctgcttgttctctcacccctaaccctagtagttcctccactaactttctcactaagtgagaatgagaactgctgtgatagggagagtgaaggagggatatgtggtagagcacttgatttcagttgaatgcctgctggtagcttttccattctgtggagctgccgttcctaataattccaggtttggtagcgtggaggagaactttgatggaaagagaaccttcccttctgtactgttaacttaaaaataaatagctcctgattcaaagtaaggaaaaaraaaaaaagaaaaaaaactcga

SEQ ID NO: 308 - DNA, 2345 bp, Homo sapiens
  SITE (2178): n equals a,t,g, or c
  SITE (2332): n equals a,t,g, or c
ttgaggccgacgctaggggcccggaagraaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggaaaaaatatttaaaattgatcagatgggaagatggtttgttgctggaggggctgctgttggtcttggagcattgtgctactatggcttgggactgtctaatgagattggagctattgaaaaggctgtaatttggcctcagtatgtcaaggatagaattcattccacctatatgtacttagcagggagtattggtttaacagctttgtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcagtggtggctcctctgacaatattagggggtcctcttctcatcagagctgcatggtacacagctggcattgtgggaggcctctccactgtggccatgtgtgcgcccagtgaaaagtttctgaacatgggtgcacccctgggagtgggcctgggtctcgtctttgtgtcctcattgggatctatgtttcttccacctaccaccgtggctggtgccactctttactcagtggcaatgtacggtggattagttcttttcagcatgttccttctgtatgatacccagaaagtaatcaagcgtgcagaagtatcaccaatgtatggagttcaaaaatatgatcccattaactcgatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatgattgctaagtgtttttttatttttgcatatttattgaactgtctaattgaatacagcttgctcttgtcacctcttcaagctttcaagcctttatagaaaagcttctttgtggcttacactggaaattatgaaagcagtttttctcctaagacttttggtttctcgcattgcctctcagactaagcactaaaaagcaaagcaaaacagaactagtnctgtcttaatgaaatatatcaacccaaaagtgtaatgaggaaaatgcttcattagtttcccctagcagacttttacttctcttacactgctacaccattactttcttgagacatttgtaagtcctttgatacagaagagttatatttaggaggnctttaatgaaggg

SEQ ID NO: 309 - DNA, 2369 bp, Homo sapiens
  SITE (26): n equals a,t,g, or c
  SITE (1598): n equals a,t,g, or c
tttttttttttttttttttttttttncaagatcattgtttatttattacttcagataaaaagatagtatacatattagggaatcccttaaaattcaactctagagttatacaccatctagtacttttgcaatgaatgttaacaacaacaaaaaaaatctctaaacacctgaaagccccactattaacatggactatggtaataaaaaattttgacatttaatttgttcaacatatagtatttacattatgaaaccaatggtgatgatacaataaagtgataaagaaatagtaaaaataaactttaaaaagcaaaggtttatagtctgacaatgctaattatcctaattgtatataaaaaattaaaacatagagctttctgttacaaaattcttaatcctctgggttgtaatcattacttgctaccaatttacatgcaacatctgctaggactgacatttgatttttttccccaagaatgtgtgagtagataaatgacatttcagagcagatattaatttacttgtggacagaaaaagaaactcaagattggtactggtcacaagcctcttcccaatagaaattataaaaacagtaagataaaatttaaaaaaaatctaaaaaggggatgcataggcaaagagtaccataaatggcacagctcaaaaaatcccaggaccaatcagacacacatcttttctctctccttcagcgacaagaggtcgattttgccatcaaataaccatgattgaagcaagcgaggggcaccaggtgtacaactgattagatcttgcaaaatactaagatgggagcaggggtggccagaagaaggggtaatttatatataattcaaactatatacagcataaatggaatgcagcccatcccaaactggctctgtgaaacaattggacctttatagttaaaattataacaagtgtaataatacaatagatttacatgggaagcaaaatccaagggacattttatattaagtatttactgtgctgtttcaatttaaaaataattttgctaagtatacatctcaactgaagtctatgtaaaaaatgtcctaatagatacagatatttacctttggtgagttgaaggcctttttgtgacttctgtctgaactgtaggcagaatgctagatgtacatgcacatatggagaaactcaagctgaggtcatccaaaagctgtgcgtatgaggaggctggaggtactttgaaagtcaaagtagaccagaaacccaaaacaggtaacagtgaggatggcaacagggaatggaatgccaatatggcagtaaaactttttttaaaaacagaaagaggaaggcctctcgtaccagcagaatcctgtacacgtacaaaaaagaaaaagccacccaccattttgtaaaacagaagccaattatagtgtgggaaagtacaaattacagaaaaccagaagtcaacagaagaaaaactactggtttacttgagagaaaggagaatggttcaccccgagcagagttacttggtgaacgccgccaccaccgcccacagaacctcattggtgttggccttcagacattccacttcagggtctaagtcgagaarntgccgcactctcttggtagccaaatcatactgctcgtccagaagaggagcaaaagcattctccaggacgtccgaggcatgagccaggtaaatgagggccagcaagcgcctgtccatgcggtgagggtcattcacccatttgtcaagaacggcttcctgtactttcttgatgaggcgctgcttaatgttgttattggtgaggggatgtgttgtcatgtcaaaaagtaggaagttctgtttctctgttgtcaatacacccttttccaccaggtttttagctaatcgttcccgtacatttcttaactgataatgcaattttaatggattccatgtctcaccactaagtaattcaatccagttctggaccgtttctggaggctgagtttccttaacatgcttcagagcttcatcaagaagaacatcccctgttggagcatctgacttacagattacctttcttgttaatagacttttacgtctcattccacaagcctctagttgtaaccttcctctcaatgctaattcaattaacatacagccacgtaatccagatgatatacagtcattccaaaatgatgtgtaaaccttcgcggtccttgaggcccagcaggagcacttcctccatcagggtcagccgcgtttccttggagtcgcccttgtcgtcgtcgtcctgctcgtcgcggcggctctgcgcgtcgtcctcgctgctagccgcgccgccgcccgccgcccgctccttgtcggcggcgttgcgggaggcctcggtgcgccg

SEQ ID NO: 310 - DNA, 1181 bp, Homo sapiens
  SITE (1181): n equals a,t,g, or c
gggacgtgtggtttcagctcgtgcgcctccccgtgggtttgcgacgtttagcgactattgcgcctgcgccacgccggctgcgagactggggccgtggytgctggtcccgggtgatgctaggcggctccctgggctccaggctgttgcggggtgtaggtgggagtcacggacggttcggggcccgaggtgtccgcgaaggtggcgcacatgggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcmcttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaatgcaaaaaaaaaaaaaaaaaaaaaaaaaaaaaaaaaaaaaaaaaaaaaaaaaaaaaan

SEQ ID NO: 311 - DNA, 1537 bp, Homo sapiens
  SITE (163): n equals a,t,g, or c
  SITE (1024): n equals a,t,g, or c
  SITE (1320): n equals a,t,g, or c
  SITE (1533): n equals a,t,g, or c
ctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaanatggagctggcccggaatggggagggttcgaagaaaacatccagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcagatgtggcaggctgggaaaagacaagcctccagggccttcagcttgtacgccaacatcgacatcctcagaccctactttgatgtggagcctgctcaggtgcgaacagggctcctggagtccatgatccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtgntagaggggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgnagctgtcggcacttctgaaagcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaaaaaaaaaaaaaaaaaaaaaaaaaaaaaaaaaaaggggggncccc

SEQ ID NO: 312 - DNA, 1493 bp, Homo sapiens
tgcatgccaaaaccaatgcctgccaaacaaaatcttagacatcccaatataatatgttagttatatttctattcacatcattattgaaaatacccagctcagtgcctggcttaataaatgtttaattcccttacctactcttgctctatttttttatttgaaatggagatgagcaaaataacacattcatggctgaagcaattttttggacatttcttgttaccaaaagatctataatcaggatgatcctgagctgttcaaacaagctgtatataaacagacaatgaaactctttgcagagctggaaattaaaaggaaagagagagaagccaaagagatgcatgaaaggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctgccttctcttcccacagcctgtaactcagtgttttgtacttcactgaattgtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaagccattgatgtacttttccttgtactctcccttgtgggtcccttgtctggcttggctgaaccccaaaatgctttggggttggacagacctggctgaaccttagtttcttcatctatgaaatgggaatatgaattactgcagcagcttttagggcagatttgccatggcatatacaaggtaactaccatagtgctccttgggtattgccaatatcctattatttctgtgtaaaatgaagatactgattgttttgag

SEQ ID NO: 313 - DNA, 577 bp, Homo sapiens
  SITE (14): n equals a,t,g, or c
aattcggcagaggnattatatacactatactggcatttactgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgwacaaaatgytaaaaaaaaaaaaaaaaaaaaaaaaaaaaaaaaaaaaaaaaaaaaaaaaaactcga

SEQ ID NO: 314 - DNA, 2860 bp, Homo sapiens
  SITE (5): n equals a,t,g, or c
  SITE (16): n equals a,t,g, or c
gtgtngaccgctctcncaatatggctcccccgggctggcagrwrktcrgtcwckrgtggctagcctgtcctgacaggggagagttaagctcccgttctccaccgtgccggctggccaggtgggctgagggtgaccgagagaccagaacctgcttgctggagcttagtgctcagagctggggagggaggttccgccgctcctctgctgtcagcgccggcagcccctcccggcttcacttcctcccgcagcccctgctactgagaagctccgggatcccagcagccgccacgccctggcctcagcctgcggggcttccagtcaggccaacaccgacgcgcactggggaggaagacaggacccttgacatctccatctgcacagaggtcctggctggaaccgagcagcctcctcctcctaggatgacctcaccctccagctctccagttttcaggttggagacattagatggaggccaagaagatggctctgaggcggacagaggaaagctggattttgggagcgggctgcctcccatggagtcacagttccagggcgaggaccggaaattcgccccttcagataagagtcaacctccaactaccgaaagggaacaggtgccagtcagccggatccaaaccgatttgaccgagatcggctcttcaatgcggtctcccggggtgtccccgaggatctggctggacttccagagtacctgagcaagaccagcaagtacctcaccgacttcggaaatacacagagggctccacaggtaagacggcctgatgaaggctgtgctgaaaccttaaggacggggtcaatgcctgcattctgccactgctgcagatcgaccgggactctggcaatcctcagcccctggtaaatgcccagtgcacagatgactattaccgaggccacagcgctctgcacatcgccattgagaaagaggagtctgcagtgtgtgaagctcctggtggagaatggggccaatgtgcatgcccgggtctgcggcgacttcttccagaagggccaagggacttgcttttatttcggtgagctacccctctctttggccgcttgcaccaagcagtgggatgtggtaagctacctcctggagaacccacaccagcccgccagcctgcaggccactgactcccagggcaacacagtcctgcatgccctagtggatgatctcggacaactcagctgagaacattgcactggtgaccagcatgtatgatgggctcctccaagctkgggsccsccytctgccctaccgtgcagcttgaggacatccgcaacctgcaggatctcacgcctctgaagctggccgccaaggagggcaagatcgagattttcaggcacatcctgcagcgggagttttcaggactgagccacctttcccgaaagttcaccgagtggtgctatgggcctgtccgggtgtcgctgtatgacctggcttctgtggacagctgtgaggagaactcagtgctggagatcattgcctttcattgcaagagcccgcaccgacaccgaatggtcgttttggagcccctgaacaaactgctgcaggcgaaatgggatctgctcatccccaagttcttcttaaacttcctgtgtaatctgatctacatgttcatcttcaccgctgttgcctaccatcagcctaccctgaagaagcaggccgcccctcacctgaaagcggaggttggaaactccatgctgctgacgggccacatccttatcctgctaggggggatctacctcctcgtggggccagctgtggtacttctggcggcgccacgtgttcatctggatctcgttcatagacagctactttggaaatcctcttcctgttccaggccctgcttcacagtggtgtcccaggtgctgtgtttcctgggccatcgagtggtacctgcccctgcttgtgtctgcgctggtggctgggctggctgaacctgctttactaatacacgtggcgttccagcacacaggcagtctacagtttcatgwtccctgaagccctggtgagcctgagccaggaggcttggcgccccgaagctcctacaggccccaatgccacagagtcagtgcagcccatggagggacaggaggacgagggcaacggggcccagtacaggggtatcctggaagcctccttggagctcttcaaattcaccatcggcatgggcgagctggccttccaggagcagctgcacttccgcggcatggtgctgctgctgctgctggcctacgtgctgctcacctacatcctgctgctcaacatgctcatcgccctcatgaagcgaacgtcacagtgtcgccactgacagctggagcatctggaagctgcagaaagccatctctgtcctggagatggagaatggctattggtggtgcaggaaaaagcagcgggcaggtgtgatgctgaccgttggcactaagcccagatggcagccccgatgagcgctggtgcttcagggtggaggaggtgaactgggcttcatggggagcagacgctgcctacgctgtgtgaggacccgtcaggggcaggtgtccctcgaactctcgagaaccctgtcctggcttcccctcccaaggaggatgaggatggtgcctctgaggaaaactatgtgcccgtccagctcctccagtccaactgatggcccagatgcagcaggaggccagaggacagagcagaggatctttccaaccacatctgctggctctggggtcccagtgaattctggtggcaaatatatattttcactaactcaaaaaaaaaaaaaaaaaaaaaaaaaaaavgagggggggcccgktasccaawttcgccctataagtgagtgccwattacgataaa

SEQ ID NO: 315 - DNA, 876 bp, Homo sapiens
  SITE (119): n equals a,t,g, or c
  SITE (120): n equals a,t,g, or c
  SITE (377): n equals a,t,g, or c
ctgcttgtgtctgcgctggtgctgggctggctgaacctgctttactatacacgtggcttccagcacacaggcatctacagtgtcatgatccagaagccctggtgagcctgagccaggannttggcgccccgaagctcctacaggccccaatgccacagagtcagtgcagcccatggagggacaggaggacgagggcaacggggcccagtacaggggtatcctggaagcctccttggagctcttcaaattcaccatcggcatgggcgagctggccttccaggagcagctgcacttccgcggcatggtgctgctgctgctgctggcctacgtgctgctcacctacatcctgctgctcaacatgctcatcgccctcatgnagcgagaccgwcaacagtgtcgccactgacagctggagcatctggaagctgcagaaagccatctctgtcctggagatggagaatggctattggtggtgcaggaagaagcagcgggcaggtgtgatgctgaccgttggcactaagccagatggcagccccgatgagcgctggtgcttcagggtggaggaggtgaactgggcttcatgggagcagacgctgcctacgctgtgtgaggacccgtcaggggcaggtgtccctcgaactctcgagaaccctgtcctggcttcccctcccaaggaggatgaggatggtgcctctgaggaaaactatgtgcccgtccagctcctccagtccaactgatggcccagatgcagcaggaggccagaggacagagcagaggatctttccaaccacatctgctggctctggggtcccagtgaattctggtggcaaatatatattttcactaamwmaaaaaaaaaaaaaaaaaaaaactcga

SEQ ID NO: 316 - DNA, 2025 bp, Homo sapiens
catgacccgcctgatgcgatcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacasgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtacagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcracaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcaaaaaaaaaaaaaaaaaaaaaaaaaaaaaaaaaaaaaaaaaaaaaaaactcgaggggggcccgtacccaattcgccgtatatgatcgtaaacaatc

SEQ ID NO: 317 - DNA, 3026 bp, Homo sapiens
  SITE (50): n equals a,t,g, or c
  SITE (1938): n equals a,t,g, or c
  SITE (2593): n equals a,t,g, or c
  SITE (3006): n equals a,t,g, or c
  SITE (3019): n equals a,t,g, or c
taggcagcactgaaatatcctaaccccctaagctccaggtgccctgtggnacgagcaactggactatagcagggctgggctctgtcttcctggtcataggctcactctttcccccaaatcttcctctggagctttgcagccaaggtgctaaaaggaataggtaggagacctcttctatctaatccttaaaagcataatgttgaacattcattcaacagctgatgccctataacccctgcctggatttcttcctattaggctataagaagtagcaagatctttacataattcagagtggtttcattgccttcctaccctctctaatggcccctccatttatttgactaaagcatcacacagtggcactagcattataccaagagtatgagaaatacagtgctttatggctctaacattactgccttcagtatcaaggctgcctggagaaaggatggcagcctcagggcttccttatgtcctccaccacaagagctccttgatgaaggtcatctttttcccctatcctgttcttcccctccccgctcctaatggtacgtgggtacccaggctggttcttgggctaggtagtggggaccaagttcattacctccctatcagttctagcatagtaaactacggtaccagtgttagtgggaagagctgggttttcctagtatacccactgcatcctactcctacctggtcaacccgctgcttccaggtatgggacctgctaagtgtggaattacctgataagggagagggaaatacaaggagggcctctggtgttcctggcctcagccagctgcccacaagccataaaccaataaaacaagaatactgagtcagttttttatctgggttctcttcattcccactgcacttggtgctgctttggctgactgggaacaccccataactacagagtctgacaggaagactggagactgtccacttctagctcggaacttactgtgtaaataaactttcagaactgctaccatgaagtgaaaatgccacattttgctttataatttctacccatgttgggaaaaactggctttttcccagccctttccagggcataaaactcaaccccttcgatagcaagtcccatcagcctattatttttttaaagaaaacttgcacttgtttttctttttacagttacttccttcctgccccaaaattataaactctaagtgtaaaaaaaagtcttaacaacagcttcttgcttgtaaaaatatgtattatacatctgtatttttaaattctgctcctgaaaaatgactgtcccattctccactcactgcatttggggcctttcccattggtctgcatgtcttttatcattgcaggccagtggacagagggagaagggagaacaggggtcgccaacacttgtgttgctttctgactgatcctgaacaagaaagagtaacactgaggcgctcgctcccatgcacaactctccaaaacacttatcctcctgcaagagtgggctttccagggtctttactgggaagcagttaagccccctcctcaccccttccttttttctttctttactcctttggcttcaaaggattttggaaaagaaacaatatgctttacactcattttcaatttctaaatttgcaggggatactgaaaaatacggcaggtggcctaaggctgctgtaaagttgaggggagaggaaatcttaagattacaagataaaaaacgaatcccctaaacaaaaagaacaatagaactggtcttccattttgccacctttcctgttcatgacagctactaacctggagacagtaacatttcattaaccaaagaaagtgggtcacctgacctctgaagagctgagtactcaggccactccaatcaccctacaagatgccaaggaggtcccaggaagtccagctccttaaactgacgctagnmaataaacctgggcaagtgaggcaagagaaatgaggaagaatccatctgtgaggtgayaggcaaggatgaaagacaaagaaggaaaagagtatcaaaggcagaaaggagatcatttagttgggtctgaaaggaaaagtctttgctatccgacatgtactgctagtacctgtaagcattttaggtcccagaatggaaaaaaaaatcagctattggtaatataataatgtcctttccctggagtcagtttttttaaaaagttaactcttagtttttacttgtttaattctaaaagagaagggagctgaggccattccctgtaggagtaaagataaaaggataggaaaagattcaaagctctaatagagtcacagctttcccaggtataaaacctaaaattaagaagtacaataagcagaggtggaaaatgatctagttcctgatagctacccacagagcaagtgatttataaatttgaaatccaaactactttcttaatatcactttggtctccatttttcccaggacaggaaatatgtccccccctaactttcttgcttcaaaaattaaaatccagcatcccaagatcattctacaagtaattttgcacagacatctcctcaccccagtgcctgtctggagctcacccaaggtcanccaaacaacttggttgtgaacccaactgccttaaccttctgggggagggggattagctagactaggagacccagaagtgaatgggaaagggtgaggacttcacaatgttggcctgtcagagcttgattagaagccaagacagtggcagcaaaggaagacttggcccaggaaaaacctgtgggttgtgctaatttctgtccagaaaatagggtggacagaagcttgtggggtgcatggaggaattgggacctggttatgttgttattctcggactgtgaattttggtgatgtaaaacagaatattctgtaaacctaatgtctgtataaataatgagcgttaacacagtaaaatattcaataagaagtcaaaaaaaaaaaaaaaaaactcgagggggggcccggtacccaatttnccaaatagagatngtattac

SEQ ID NO: 318 - DNA, 712 bp, Homo sapiens
gcaggctttgtgctcacctacaagctgggtgagcagggtgccagcagcctgtttcctcttctcctgctggaccacggcgtttctgctcccgagttgggactgtggaatggtgtgggtgctgtggtctgctccatcgctggctcctccctgggtgggaccttgctggccaagcactggaaactgctgcctctgttgargtcggtgctgcgcttccgcctcgggggcctagcctgtcagactgccttggtcttccacctggacaccctgggggccagcatggacgctggcacaatcttgagagggtcagccttgctgagcctatgtctgcagcacttcttgggaggcctggtcaccacagtcaccttcactgggatgatgcgctgcagccagctggcccccagggcctgcaggccacacactacagccttctggccacgctggagctgctggggaagctgctgctgggcactctgcggaggcctggctgatgggttggggccacatccctgcttcttgctcctgctcatcctctctgcctttcccgttctgtacctggacctagcacccagcacctttctctgagctgagtggctggagtggtcaataaagccacatgtgcctgtggcccaaaaaaaaaaaaaaaaaaaaaaaaaaaaaaaaaactggagggggggcccggtacccaaatcgccggatatgatcgtaaacaatc

SEQ ID NO: 319 - DNA, 1289 bp, Homo sapiens
  SITE (1273): n equals a,t,g, or c
  SITE (1287): n equals a,t,g, or c
caaaatttcagaactttcaggagggcaagagaatatcaaacaaagatttctggaagtattttgccaaccttctggttgagctgcaagaaaatatttatggtgagaacttttctgtttcccgttattgggtttttggttggtttttgtttgttttttactatgctttggtctgtaaaaatatgcaactgaactacattcagaaggaaatattgtctacatagaatattatatgaagttggtacataattctgatgaggaaaaaaaatctttgcaattctttaagccatattgttgtttttctgtgttgttttccctggatgaaaatatcagtattaagtagacagcatattattcaagtgtttagacttattaatatgttcttgtcctgtatttatacatatgtgtattttggaaagtattgccttttttaagggaagctataattcgatacatagtgaaaaagggaatggtgacccctttgtgcctcttccactgaggataacaaacagcattgtaatccattctcttgcaccttcttcttcttatcttgttattacggttttattaattttgtagagggacagggagtgggcaaggggaagaagcagcttatttgactaaccagcccctctgtggtccaccagcgtcttggcttggtgggagggctctcaatcagcagggccccaggagggaagaagaagtggggcaaagcctggcctcgccgctcgggagctttgccatctgagccacgcctcctccaggccatgctccttgaacttggaaatgtcaaccggagcccttacaccagccctccagcatctaatagacttgaatctactctaaacgaatatttaatccaacctcactacattgtagctcagtccaacgactaaccctgaaatgggggtgttccagccttcagcgagatggccaagcggtcccctgggggctgtggcagcgggcttatccttctctgttgccaaccttgccgtccgacctcctccgcccccatgcggtgaccccgtccgtgtctgtgtctgtccatacgtgtgagtccagctaaaaagacaaaacagaacccgtgggcccagctcggaaggtgcgtggagaaggctccgacgtctccgaagtgcagcccttgggatggcattccgttgtgtgccttattcctggagaatctgtatacggctcgcctatagaaatatagcctcttcatgctgtattaaaaggacttttaaaagcaaaaaaaaaaaaaaaaaacttgagggggggnccggtacccaattntc

SEQ ID NO: 320 - protein, 22 aa, Homo sapiens
MFLIFVYFLKILFSSSLPFLWL

SEQ ID NO: 321 - protein, 128 aa, Homo sapiens [sequence omitted]

SEQ ID NO: 322 - protein, 28 aa, Homo sapiens
MQFLLTAFLLVPLLALCDVPISLGFSPS

SEQ ID NO: 323 - protein, 64 aa, Homo sapiens
  SITE (43): Xaa equals any of the naturally occurring L-amino acids
  SITE (51): Xaa equals any of the naturally occurring L-amino acids
  SITE (63): Xaa equals any of the naturally occurring L-amino acids
MDGFSSRLFSSLPFVALQWFIVISHLLSLSLSACCYQTHCSLXQLSSAFSXMGESCVGEREYXF

SEQ ID NO: 324 - protein, 21 aa, Homo sapiens
MPLINLLLLYYVPNGGKQDKK

SEQ ID NO: 325 - protein, 39 aa, Homo sapiens [sequence omitted]

SEQ ID NO: 326 - protein, 33 aa, Homo sapiens
MLWWSRDYTMVFLLFTMVFTGDLVIRGRTELSL

SEQ ID NO: 327 - protein, 88 aa, Homo sapiens
MVCSSLCDIGGIITPFIVFRLREVWQALPLILFAVLGLLAAGVTLLLPETKGVALPETMKDAENLGRKAKPKENTIYLKVQTSEPSGT

SEQ ID NO: 328 - protein, 23 aa, Homo sapiens
MQPGAGVLVLGLLLPPPQSPSLS

SEQ ID NO: 329 - protein, 27 aa, Homo sapiens
MTFTLGDSQVLLINLFPSMPSGSCARP

SEQ ID NO: 330 - protein, 64 aa, Homo sapiens
  SITE (64): Xaa equals stop translation
MCLECWAENLGPHHTSSLLNPRHLPSIPAMFPVSSGCFQEQQEMNKSLVSCLFVLHFVLHCIFX

SEQ ID NO: 331 - protein, 196 aa, Homo sapiens
MLSTSEYSQSPKMESLSSHRIDEDGENTQIEDTEPMSPVLNSKFVPAENDSILMNPAQDGEVQLSQNDDKTKGDDTDTRDDISILATGCKGREETVAEEVCIDLTCDSGSQAVPSPATRSEALSSVLDQEEAMEIKEHHPEEGSSGSEVEEIPETPCESQGEELKEENMESVPLHLSLTETQSQGLCLRRHPKKKK

SEQ ID NO: 332 - protein, 252 aa, Homo sapiens
  SITE (34): Xaa equals any of the naturally occurring L-amino acids
  SITE (35): Xaa equals any of the naturally occurring L-amino acids
  SITE (163): Xaa equals any of the naturally occurring L-amino acids
  SITE (167): Xaa equals any of the naturally occurring L-amino acids
  SITE (252): Xaa equals stop translation
MGGDLVLGLGALRRRKRLLEQEKSLAGWALVLAXXGIGLMVLHAEMLWFGGCSAVNATGHLSDTLWLIPITFLTIGYGDVVPGTMWGKIVCLCTGVMGVCCTALLVAVVARKLEFNKAEKHVHNFMMDIQYTKEMKESAARVLQEAWMFYKHTRRKESHAARXHQRXLLAAINAFRQVRLKHRKLREQVNSMVDISKMHMILYDLQQNLSSSHRALEKQIDTLAGKLDALTELLSTALGPRQLPEPSQQSKX

SEQ ID NO: 333 - protein, 68 aa, Homo sapiens
  SITE (68): Xaa equals stop translation
MWRCRGKLSFPLFAVVIVSCRKDGPDAAAAPAVIKNNSHYQTSKALELEKTTENKESNPFILQVNKLX

SEQ ID NO: 334 - protein, 84 aa, Homo sapiens
  SITE (84): Xaa equals stop translation
MGEGKNGFGGFVHTADACWEGVHSEPVCRTVHTVHTCHHQAFLVLIGWSKSGKERKEAFLTAIILNSRSIHISCSWPPSPVPQX

SEQ ID NO: 335 - protein, 36 aa, Homo sapiens
MLLINLLWLVTMIKSVINNNIILFLKKKSLFFIDSV

SEQ ID NO: 336 - protein, 63 aa, Homo sapiens
  SITE (63): Xaa equals stop translation
MTFPFEKKIVAFSAFYLIPGESRLAPTFNPSADMTVILRGRAQHKTAMLESYNWKVSCQLREX

SEQ ID NO: 337 - protein, 35 aa, Homo sapiens
MHSKGSSLLLFLPQLILILPVCAHLHEELNCCFHR

SEQ ID NO: 338 - protein, 23 aa, Homo sapiens
MGALVLLLCLLVGVQQSGSVWDS

SEQ ID NO: 339 - protein, 40 aa, Homo sapiens [sequence omitted]

SEQ ID NO: 340 - protein, 111 aa, Homo sapiens
  SITE (111): Xaa equals stop translation
MQSLVQWGLDSYDYLQNAPPGFFPRLGVIGFAGLIGLLLARGSKIKKLVYPPGFMGLAASLYYPQQAIVFAQVSGERLYDWGLRGYIVIEDLWKENFQKPGNVKNSPGTKX

SEQ ID NO: 341 - protein, 106 aa, Homo sapiens
  SITE (53): Xaa equals any of the naturally occurring L-amino acids
  SITE (80): Xaa equals any of the naturally occurring L-amino acids
  SITE (96): Xaa equals any of the naturally occurring L-amino acids
  SITE (102): Xaa equals any of the naturally occurring L-amino acids
MAPSLLLLAPLCSLEAVLSSPLEKQCQLPGIFCQLQLPCPLLLSAQLLKGIVXPRCPASLPQPPHPAPSWHLPLHCTERXPHHLPLQGGSSNMEEXNYRGYXDAQL

SEQ ID NO: 342 - protein, 50 aa, Homo sapiens
  SITE (50): Xaa equals stop translation
MTTCLFGLLSCEMSAQVSQKSCVYDESECFSSVGQLLALLILVYVLPSIX

SEQ ID NO: 343 - protein, 48 aa, Homo sapiens
MLWKCSQNIARCLLLLLALVEIKLEDLQSQLHPTWKSIPGPSPRNQHR

SEQ ID NO: 344 - protein, 41 aa, Homo sapiens
  SITE (41): Xaa equals stop translation
MLIPLQCLFSSDRMLTFLTPWQKGEKCVLGWVTKFLSEISX

SEQ ID NO: 345 - protein, 76 aa, Homo sapiens [sequence omitted]

SEQ ID NO: 346 - protein, 83 aa, Homo sapiens
  SITE (76): Xaa equals any of the naturally occurring L-amino acids
MAGASLGAHRAFGGLRVLTFDFLQVGGKPDHDDQSLHILDLHGADPALPGSHQVYATTFCSKFRIRVTSGEHCPQXNANGLAA

SEQ ID NO: 347 - protein, 42 aa, Homo sapiens
MAKISPFEVVKRTSVPVLVGLVIVIVATELMVPGTAAAVTGK

SEQ ID NO: 348 - protein, 26 aa, Homo sapiens
MRLFFIGFLLLFSFGLLRQPSLSAEH

SEQ ID NO: 349 - protein, 26 aa, Homo sapiens
MVFSVSSALALLLMLLRSSDLAKKTE

SEQ ID NO: 350 - protein, 157 aa, Homo sapiens
  SITE (157): Xaa equals stop translation
MSLEFYQKKKSRWPFSDECIPWEVWTVKVHVVALATEQERQICREKVGEKLCEKIINIVEVMNRHEYLPKMPTQSEVDNVFDTGLRDVQPYLYKISFQITDALGTSVTTTMRRLIKDTLPSERRWISGSSLMAPRPWLLGIALLGLWALEPALGHWX

SEQ ID NO: 351 - protein, 520 aa, Homo sapiens
  SITE (385): Xaa equals any of the naturally occurring L-amino acids
  SITE (520): Xaa equals stop translation
MFLLPLPAAGRVVVRRLAVRRFGSRSLSTADMTKGLVLGIYSKEKEDDVPQFTSAGENFDKLLAGKLRETLNISGPPLKAGKTRTFYGLHQDFPSVVLVGLGKKAAGIDEQENWHEGKENIRAAVAAGCRQIQDLELSSVEVDPCGDAQAAAEGAVLGLYEYDDLKQKKKMAVSAKLYGSGDQEAWQKGVLFASGQNLARQLMETPANEMTPTRFAEIIEKNLKSASSKTEVHIRPKSWIEEQAMGSFLSVAKGSDEPPVFLEIHYKGSPNANEPPLVFVGKGITFDSGGISIKASANMDLMRADMGGAATICSAIVSAAKLNLPINIIGLAPLCENMPSGKANKPGDVVRAKNGKTIQVDNTDAEGRLILADALCYAHTFNPKXILNAATLTGAMDVALGSGATGVFTNSSWLWNKLFEASIETGDRVWRMPLFEHYTRQVVDCQLADVNNIGKYRSAGACTAAAFLKEFVTHPKWAHLDIAGVMTNKDEVPYLRKGMTGRPTRTLIEFLLRFSQDNAX

SEQ ID NO: 352 - protein, 39 aa, Homo sapiens
TILFLFLQLSALRLIVGKDSIDIDISSRRREDQSLRLNA

SEQ ID NO: 353 - protein, 234 aa, Homo sapiens
  SITE (234): Xaa equals stop translation
MTSELDIFVGNTTLIDEDVYRLWLDGYSVTDAVALRVRSGILEQTGATAAVLQSDTMDHYRTFHMLERLLHAPPKLLHQLIFQIPPSRQALLIERYYAFDEAFVREVLGKKLSKGTKKDLDDISTKTGITLKSCRRQFDNFKRVFKVVEEMRGSLVDNIQQHFLLSDRLARDYAAIVFFANNRFETGKKKLQYLSFGDFAFCAELMIQNWTLGPVDSQMDDMDMDLDRNFSRTX

SEQ ID NO: 354 - protein, 169 aa, Homo sapiens
  SITE (169): Xaa equals stop translation
MAAAVAGMLRGGLLPQAGRLPTLQTVRYGSKAVTRHRRVMHFQRQKLMAVTEYIPPKPAIHPSCLPSPPSPPQEEIGLIRLLRREIAAVFQDNRMIAVCQNVALSAEDKLLIATPAAETQDPDEGLPQPGPESPSWRIPSTKICCPFLWGTTCCWSVKSPRSRRWYGSX

SEQ ID NO: 355 - protein, 43 aa, Homo sapiens
MKRSFLLPLLLVGFLDTAHLILLETLSVCLWLPSLIDSRCVMS

SEQ ID NO: 356 - protein, 78 aa, Homo sapiens [sequence omitted]

SEQ ID NO: 357 - protein, 24 aa, Homo sapiens
MSEILSLLFCLLGPALDERREEKD

SEQ ID NO: 358 - protein, 274 aa, Homo sapiens
  SITE (108): Xaa equals any of the naturally occurring L-amino acids
  SITE (178): Xaa equals any of the naturally occurring L-amino acids
  SITE (226): Xaa equals any of the naturally occurring L-amino acids
  SITE (228): Xaa equals any of the naturally occurring L-amino acids
  SITE (229): Xaa equals any of the naturally occurring L-amino acids
  SITE (274): Xaa equals stop translation
MSSAGTATPLEMDHKLTSQPGRPSFYCNSRHSIVGSSHQLGFWFSHLESSGLKVFQVSLPCECVNLPTRIASVVLSLMSLLVVGQAPAWEGSLLRGRPAGGAHLCAMXVIEGLVVDVGERILHGQREVGQVSQVLPALSLGLVFLCQGTVEKVSGAAHCSSLLCCLPWQCSGGGFPTXRCSRPYFSSHKGVAATLALTCHCDKVHVAGLGKDWAIEQRRRTCESDXEXXPFTLAGLVLVLRFCQVVLVWIPQLGDKHWRGMTRLGRVSLTSSIX

SEQ ID NO: 359 - protein, 47 aa, Homo sapiens
  SITE (47): Xaa equals stop translation
MIFTSVTKGILLIALWVPLFHFMLIDSILGPSRLLTDGVPFNPWHVX

SEQ ID NO: 360 - protein, 117 aa, Homo sapiens
MWLLSAILWASLWMARMASRSLSASGRVDLNWSWAEIRPSISSMVWTMNMSWRSSMALSIQLLKGAARLAYSRCSWSMASSCFSVFSRASLRLCVREPRASHWSQIFWHRVLTLWES

SEQ ID NO: 361 - protein, 52 aa, Homo sapiens
  SITE (19): Xaa equals any of the naturally occurring L-amino acids
  SITE (32): Xaa equals any of the naturally occurring L-amino acids
MSISGTDGLILLLVGLEAXVRSSKKWIPKALXVTQAKWNSWPSRRNAGFALH

SEQ ID NO: 362 - protein, 132 aa, Homo sapiens
  SITE (132): Xaa equals stop translation
MEHCLYHSVHGINPYIHKNTHPSINIYMVWDEQVNSFEREFVPFFFLIILLNCCQLSNKQTEKLFGKTLHTPFLSSALKYRLNTHILPVFSYSDSILTCHLILASYFSHVYLPVTCICYLNRKKNIQKKKNX

SEQ ID NO: 363 - protein, 204 aa, Homo sapiens
  SITE (204): Xaa equals stop translation
MGSRDHLFKVLVVGDAAVGKTSLVQDYSQDSFSKHYKSTVGVDFALKVLQWSDYEIVRLQLWDIAGQERFTSMTRLYYRDASACVIMFDVTNATTFSNSQRWKQDLDSKLTLPNGEPVPCLLLANKCDLSPWAVSRDQIDRFSKENGFTGWTETSVKENKNINEAMRVLIEKMMRNSTEDIMSLSTQGDYINLQTKSSSWSCCX

SEQ ID NO: 364 - protein, 47 aa, Homo sapiens
MISLIFQLEEEKLVEKFFFFLFFFLKKGSQGSNLKIVPRHMRVVLRG

SEQ ID NO: 365 - protein, 73 aa, Homo sapiens
  SITE (73): Xaa equals stop translation
MTYVTCLHVCLLVEFLNSQLTNHRKYYFLSYGFWFTGLRGFSEYLWPQQHTSFHPNRNEINFVSTDNRIWVTX

SEQ ID NO: 366 - protein, 102 aa, Homo sapiens
  SITE (102): Xaa equals stop translation
MSDQEAKPSTEDLGDKKEGEYIKLKVIGQDSSEIHFKVKMTTHLKKLKESYCQRQGVPMNSLRFLFEGQRIADNHTPKELGMEEEDVIEVYQEQTGGHSTVX

SEQ ID NO: 367 - protein, 48 aa, Homo sapiens
MGFPQWHLGNHAVEPVTSILLLFLLMMLGVRGLLLVGLVYLVSHLSQR

SEQ ID NO: 368 - protein, 179 aa, Homo sapiens
  SITE (175): Xaa equals any of the naturally occurring L-amino acids
  SITE (179): Xaa equals stop translation
MSAEVKVTGQNQEQFLLLAKSAKGAALATLIHQVLEAPGVYVFGELLDMPNVRELAESDFASTFRLLTVFAYGTYADYLAEARNLPPLTEAQKNKLRHLSVVTLAAKVKCIPYAVLLEALALRNVRQLEDLVIEAVYADVLRGSLDQRNQRLEVDYSIGRDIQRQDLSAIARTLXKNHX

SEQ ID NO: 369 - protein, 25 aa, Homo sapiens
MKSSSLFFFFLAHFIHSHDLPGLCR

SEQ ID NO: 370 - protein, 224 aa, Homo sapiens
  SITE (8): Xaa equals any of the naturally occurring L-amino acids
  SITE (212): Xaa equals any of the naturally occurring L-amino acids
  SITE (224): Xaa equals stop translation
MKFAASGXFLHHMAGLSSSKLSMSKALPLTKVVQNDAYTAPALPSSIRTKALTNMSRTLVNKEEPPKELPAAEPVLSPLEGTKMTVNNLHPRVTEEDIVELFCVCGALKRARLVHPGVAEVVFVKKDDAITAYKKYNNRCLDGQPMKCNLHMNGNVITSDQPILLRLSDSPSMKKESELPRRVNSASSSNPPAEVDPDTILKALFKSSGASXTTQPTEFKIKLX

SEQ ID NO: 371 - protein, 349 aa, Homo sapiens
  SITE (349): Xaa equals stop translation
MSKNCIKLLCEDPVFAEYIKCILMDERTFLNNNIVYTFMTHFLLKVQSQVFSEANCANLISTLITNLISQYQNLQSDFSNRVEISKASASLNGDLRALALLLSVHTPKQLNPALIPTLQELLSKCRTCLQQRNSLQEQEAKERKTKDDEGATPIKRRRVSSDEEHTVDSCISDMKTETREVLTPTSTSDNETRDSSIIDPGTEQDLPSPENSSVKEYRMEVPSSFSEDMSNIRSQHAEEQSNNGRYDDCKEFKDLHCSKDSTLAEEESEFPSTSISAVLSDLADLRSCDGQALPSQDPEVALSLSCGHSRGLFSHMQQHDILDTLCRTIESTIHVVTRISGKGNQAASX

SEQ ID NO: 372 - protein, 467 aa, Homo sapiens
  SITE (158): Xaa equals any of the naturally occurring L-amino acids
  SITE (279): Xaa equals any of the naturally occurring L-amino acids
  SITE (341): Xaa equals any of the naturally occurring L-amino acids
MLHQDHITFAMLLARIKLKGTVGEPTYDAEFQHFLRGNEIVLSAGSTPRIQGLTVEQAEAVVRLSCLPAFKDLIAKVQADEQFGIWLDSSSPEQTVPYLWSEETPATPIGQAIHRLLLIQAFRPDRLLAMAHMFVSTNLGESFMSIMEQPLDLTHIVXTEVKPNTPVLMCSVPGYDASGHVEDLAAEQNTQITSIAIGSAEGFNQADKAINTAVKSGRWVMLKNVHLAPGWLMQLEKKLHSLQPHACFRLFLTMEINPKVPVNLLRAGRIFVFEPPPGXKANMLRTFSSIPVSRICKSPNERARLYFLLAWFHAIIQERLRYAPLGWSKKYEFGESDLRSXCDTVDTWLDDTAKGRQNISPDKIPWSALKTLMAQSIYGGRVDNEFDQRLLNTFLERLFTTRSFDSEFKLACKVDGHKDIQMPDGMQARGVCAVGGVAPRHPDALLAGPAQQRRESPPYHTGCGHDQ

SEQ ID NO: 373 - protein, 152 aa, Homo sapiens
  SITE (146): Xaa equals any of the naturally occurring L-amino acids
  SITE (152): Xaa equals stop translation
MADEATRRVVSEIPVLKTNAGPRDRELWVQRLKEEYQSLIRYVENNKNADNDWFRLESNKEGTRWFGKCWYIHDLLKYEFDIEFDIPITYPTTAPEIAVPELDGKTAKMYRGGKICLTDHFKPLWGQECAQIWTSSSHGSGAGSMXGSGNPX

SEQ ID NO: 374 - protein, 373 aa, Homo sapiens
  SITE (175): Xaa equals any of the naturally occurring L-amino acids
  SITE (373): Xaa equals stop translation
MYDGTKEVPMNPVKIYQVCDIPQPQGSIINPGSTGSAPWDEKDNDVDEEDEEDELDQSQHHVPIQDTFPFLNINGSPMAPASVGNCSVGNCSPEAVWPKTEPLEMEVPQAPIQPFYSSPELWISSLPMTDLDIKFQYRGKEYGQTMTVSNPQGCRLFYGDLGPMPDQEELFGPVXLEQVKFPGPEHITNEKQKLFTSKLLDVMDRGLILEVSGHAIYAIRLCQCKVYWSGPCAPSLVAPNLIERQKKVKLFCLETFLSDLIAHQKGQIEKQPPFEIYLCFGEEWPDGKPLERKLILVQVIPVVARMIYEMFSGDFTRSFDSGSVRLQISTPDIKDNIVAQLKQLYRILQTQESWQPMQPTPSMQLPPALPPQX

SEQ ID NO: 375 - protein, 83 aa, Homo sapiens
  SITE (83): Xaa equals stop translation
MGSSVLPFCVCVTSPSLGGRCIQGRFASHSKFWGFGRKTASFGAVGETPPDQEPQKETEPATSSHARPWARVIGLRIWPQPNX

SEQ ID NO: 376 - protein, 97 aa, Homo sapiens
MTKKKRENLGVALEIDGLEEKLSQCRRDLEAVNSRLHSRELSPEARRSLEKEKNSLMNKASNYEKELKFLRQENRKNMLLSVAIFILLTLVYAYWTM

SEQ ID NO: 377 - protein, 227 aa, Homo sapiens
MGASARLLRAVIMGAPGSGKGTVSSRITTHFELKHLSSGDLLRDNMLRGTEIGVLAKAFIDQGKLIPDDVMTRLALHELKNLTQYSWLLDGFPRTLPQAEALDRAYQIDTVINLNVPFEVIKQRLTARWIHPASGRVYNIEFNPPKTVGIDDLTGEPLIQREDDKPETVIKRLKAYEDQTKPVLEYYQKKGVLETFSGTETNKIWPYVYAFLQTKVPQRSQKASVTP

SEQ ID NO: 378 - protein, 79 aa, Homo sapiens
  SITE (79): Xaa equals stop translation
MFLNCEILEYCYYLTQLKISMGKYLSIPTVLLKIIRCSITAVSDSSTSWAIKAQLKIENKDLDNKTAKGGGQEALTCTX

SEQ ID NO: 379 - protein, 51 aa, Homo sapiens
  SITE (50): Xaa equals any of the naturally occurring L-amino acids
  SITE (51): Xaa equals any of the naturally occurring L-amino acids
MRAVFPCCPFLTLMLPLLECLVGMIMCYLGISFTDTRKTAGLKKKKKKKXX

SEQ ID NO: 380 - protein, 61 aa, Homo sapiens
  SITE (61): Xaa equals stop translation
MFLMRMHLCFCKYCCSFIVTPTSTSNTASYLWPWISASMAGRGSSWACTLNAVTREGLPEX

SEQ ID NO: 381 - protein, 40 aa, Homo sapiens
  SITE (40): Xaa equals stop translation
MSLLNTHTLCFVLFCFTLSINQEKLANHLAFRILFFIVFX

SEQ ID NO: 382 - protein, 44 aa, Homo sapiens
  SITE (44): Xaa equals stop translation
MCSGQSQVWKMALQALDSETVVILPDMHLILSLRLIHNARPCLX

SEQ ID NO: 383 - protein, 203 aa, Homo sapiens
  SITE (203): Xaa equals stop translation
MLISEEEIPFKDDPRDETYKPHLERETPKPRRKSGKVKEEKEKKEIKVEVEVEVKEEENEIREDEEPPRKRGRRRKDDKSPRLPKRRKKPPIQYVRCEMEGCGTVLAHPRYLQHHIKYQHLLKKKYVCPHPSCGRLFRLQKQLLRHAKHHTDQRDYICEYCARAFKSSHNLAVHRMIHTGEKHYNVRSVDLLVDKRHLLIGTX

SEQ ID NO: 384 - protein, 29 aa, Homo sapiens
MLPRRTFYFYFIFIFFLASFWGFTLRASF

SEQ ID NO: 385 - protein, 136 aa, Homo sapiens
  SITE (136): Xaa equals stop translation
MFDSLSYFKGSSLLLMLKTYLSEDVFQHAVVLYLHNHSYASIQSDDLWDSFNEVTNQTLDVKRMMKTWTLQKGFPLVTVQKKGKELFIQQERFFLNMKPEIQPSDTRYMPSFFSCHLFCTLRWKYFEVFYNHKFLX

SEQ ID NO: 386 - protein, 41 aa, Homo sapiens
MAWRRREPASGLAACWLWRCSPWPCACPGPGAGLSSGSRPW

SEQ ID NO: 387 - protein, 468 aa, Homo sapiens
  SITE (468): Xaa equals stop translation
MEFLKVARRNKREQLEQIQKELSVLEEDIKRVEEMSGLYSPVSEDSTVPQFEAPSPSHSSIIDSTEYSQPPGFSGSSQTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANSQGTIKVLELVX

SEQ ID NO: 388 - protein, 29 aa, Homo sapiens
MRKEDGFWFFFFLFFFVVGSKFVNGNKLV

SEQ ID NO: 389 - protein, 29 aa, Homo sapiens
MPLAPYCDLLVALSFALVLESPVDSSDFT

SEQ ID NO: 390 - protein, 138 aa, Homo sapiens
MNSLVSWQLLLFLCATHFGEPLEKVASVGNSRPTGQQLESLGLLAPGEQSLPCTERKPAATARLSRRGTSLSPPPESSGSPQQPGLSAPHSRQIPAPQGAVLVQREKDLPNYNWNSFGLRFGKREAAPGNHGRSAGRG

SEQ ID NO: 391 - protein, 74 aa, Homo sapiens
  SITE (8): Xaa equals any of the naturally occurring L-amino acids
  SITE (23): Xaa equals any of the naturally occurring L-amino acids
  SITE (38): Xaa equals any of the naturally occurring L-amino acids
  SITE (43): Xaa equals any of the naturally occurring L-amino acids
  SITE (44): Xaa equals any of the naturally occurring L-amino acids
  SITE (73): Xaa equals any of the naturally occurring L-amino acids
MSCFIDSXDSKILHLLVVSFICXLFLLILTHGILILRXFFSVXXHSLKNNLEEYLILMNKALLTREDFFVLPXA

SEQ ID NO: 392 - protein, 521 aa, Homo sapiens
  SITE (521): Xaa equals stop translation
MSAGEVERLVSELSGGTGGDEEEEWLYGDENEVERPEEENASANPPSGIEDETAENGVPKPKVTETEDDSDSDSDDDEDDVHVTIGDIKTGAPQYGSYGTAPVNLNIKTGGRVYGTTGTKVKGVDLDAPGSINGVPLLEVDLDSFEDKPWRKPGADLSDYFNYGFNEDTWKAYCEKQKRIRMGLEVIPVTSTTNKITVQQGRTGNSEKETALPSTKAEFTSPPSLFKTGLPPSRRLPGAIDVIGQTITISRVEGRRRANENSNIQVLSERSATEVDNNFSKPPPFFPPGAPPTHLPPPPFLPPPPTVSTAPPLIPPPGFPPPPGAPPPSLIPTIESGHSSGYDSRSARAFPYGNVAFPHLPGSAPSWPSLVDTSKQWDYYARREKDRDRERDRDRERDRDRDRERERTRERERERDHSPTPSVFNSDEERYRYREYAERGYERHRASREKEERHRERRHREKEETRHKSSRSNSRRRHESEEGDSHRRHKHKKSKRSKEGKEAGSEPAPEQESTEATPAEX

SEQ ID NO: 393 - protein, 137 aa, Homo sapiens [sequence omitted]

SEQ ID NO: 394 - protein, 186 aa, Homo sapiens
  SITE (186): Xaa equals stop translation
MAAQKDQQKDAEAEGLSGTTLLPKLIPSGAGREWLERRRATIRPWSTFVDQQRFSRPRNLGELCQRLVRNVEYYQSNYVFVFLGLILYCVVTSPMLLVALAVFFGACYILYLRTLESKLVLFGREVSPAHQYALAGGISFPFFWLAGAGSAVFWVLGATLVVIGSHAAFHQIEAVDGEELQMEPVX

SEQ ID NO: 395 - protein, 1 aa, Homo sapiens
M

SEQ ID NO: 396 - protein, 299 aa, Homo sapiens
  SITE (299): Xaa equals stop translation
MLSIFYFAIPVGSGLGYIAGSKVKDMAGDWHWALRVTPGLGVVAVLLLFLVVREPPRGAVERHSDLPPLNPTSWWADLRALARNPSFVLSSLGFTAVAFVTGSLALWAPAFLLRSRVVLGETPPCLPGDSCSSSDSLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGALPGHRHLHX

SEQ ID NO: 397 - protein, 49 aa, Homo sapiens
MGPQGWVRPLKTAPKLGEAIRLILFLNFVKQCIASVNLCILRLNITPLL

SEQ ID NO: 398 - protein, 61 aa, Homo sapiens
  SITE (61): Xaa equals stop translation
MYVNYGTRNYSTEGPAALLDQAKLSLLVWVLCFVLLFVCFCGLSYVVIAQVPVGLLCITEX

SEQ ID NO: 399 - protein, 79 aa, Homo sapiens
  SITE (74): Xaa equals any of the naturally occurring L-amino acids
MLWFANFFTYLFLSQSVAFVHISHIGVRQVNTNCYFSRKSYCYGILNPINCIKGKKKKKKKKKKKKKKIPAGRXLFPFG

SEQ ID NO: 400 - protein, 36 aa, Homo sapiens
MPGAFSETVINDLLSLFLVLPAELSYSTLSGVYRNA

SEQ ID NO: 401 - protein, 180 aa, Homo sapiens
  SITE (126): Xaa equals any of the naturally occurring L-amino acids
  SITE (177): Xaa equals any of the naturally occurring L-amino acids
  SITE (180): Xaa equals stop translation
MAQSRDGGNPFAEPSELDNPFQDPAVIQHRPSRQYATLDVYNPFETREPPPAYEPPAPAPLPPPSAPSLQPSRKLSPTEPKNYGSYSTQASAAAATAELLKKQEELNRKAEELDRRSESCSMLPWXAQLLDRTIGPLYLLFVQFSPAFSRTSPWRSPKNFRRLYPPCTTSGCAARWXFSX

SEQ ID NO: 402 - protein, 21 aa, Homo sapiens
MPTPCTSLPSCCQHRSITMTL

SEQ ID NO: 403 - protein, 60 aa, Homo sapiens
MPLFIPLIFFLSLLHCQSKHPIQMSLCMCVNISLVWSPVRWIFGSKGLFSVHLQSSQRPS

SEQ ID NO: 404 - protein, 185 aa, Homo sapiens
  SITE (7): Xaa equals any of the naturally occurring L-amino acids
MAGPRPXWRDQLLFMSIIVLVIVVICLMLYALLWEAGNLTDLPNLRIGFYNFCLWNEDTSTLQCHQFPELEALGVPRVGLGLARLGVYGSLVLTLFAPQPLLLAQCNSDERAWRLAVGFLAVSSVLLAGGLGLFLSYVWKWVRLSLPGPGFLALGSAQALLILLLIAMAVFPLRAERAESKLESC

SEQ ID NO: 405 - protein, 480 aa, Homo sapiens
  SITE (16): Xaa equals any of the naturally occurring L-amino acids
  SITE (27): Xaa equals any of the naturally occurring L-amino acids
  SITE (33): Xaa equals any of the naturally occurring L-amino acids
  SITE (35): Xaa equals any of the naturally occurring L-amino acids
  SITE (36): Xaa equals any of the naturally occurring L-amino acids
  SITE (41): Xaa equals any of the naturally occurring L-amino acids
  SITE (57): Xaa equals any of the naturally occurring L-amino acids
  SITE (480): Xaa equals stop translation
MSDGFDRAPGAGRGRXRGLGRGGGGPXGGGFPXGXXPAERXRHQPPQPKAPGFLQPXPLRQPRTTPPPGAQCEVPASPQRPSRPGALPEQTRPLRAPPSSQDKIPQQNSESAMAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDYQEKYQELLEREDFFPDYEENGTDLSGAGDPYLDDIDDEMDPEIEEAYEKFCLESERKRKQX

SEQ ID NO: 406 - protein, 193 aa, Homo sapiens [sequence omitted]

SEQ ID NO: 407 - protein, 78 aa, Homo sapiens
  SITE (78): Xaa equals stop translation
MLRLDIINSLVTTVFMLIVSVLALIPETTTLTVGGGVFALVTAVCCLADGALIYRKLLFNPSGPYQKKPVHEKKEVLX

SEQ ID NO: 408 - protein, 74 aa, Homo sapiens
  SITE (74): Xaa equals stop translation
MLKQVMFVFSGMGPRSHCWGLPLHVAPLCRGHQADSSHLLPLKHQGAWNRNLANQRHFFCPSIFHTCPTVLFFX

SEQ ID NO: 409 - protein, 20 aa, Homo sapiens
ARTILVLYLSLQRLENLAYH

SEQ ID NO: 410 - protein, 87 aa, Homo sapiens [sequence omitted]

SEQ ID NO: 411 - protein, 92 aa, Homo sapiens
MNAAMVHINRALKLIIRLFLVEDLVDSLKLAVFMWLMTYVGAVFNGITLLILAELLIFSVPIVYEKYKTQIDHYVGIARDQTKSIVEKIPSK

SEQ ID NO: 412 - protein, 21 aa, Homo sapiens
MACSCLMIQSFSTSALVLFYG

SEQ ID NO: 413 - protein, 174 aa, Homo sapiens
  SITE (143): Xaa equals any of the naturally occurring L-amino acids
  SITE (174): Xaa equals stop translation
MEEGGNLGGLIKMVHLLVLSGAWGMQMWVTFVSGFPAFPKPSPTYLRTSAEQTLPLLLPHLHGLCLHQPLHLGFTACLGSAHILGGQPALPAVPEPYAGHCQRPLAGTPHHSCHVGPANRGRRSEAWVGRYQAANRFPILNAXCERRTPSTVLSARISSATMGCPLFAIWAASX

SEQ ID NO: 414 - protein, 64 aa, Homo sapiens
  SITE (64): Xaa equals stop translation
MAFILLFYCLMTFLSLEQNSATVEPSSHEILHLLQNCFELLRTSTSQCTEGIPCQRYQNGLHIX

SEQ ID NO: 415 - protein, 280 aa, Homo sapiens
  SITE (280): Xaa equals stop translation
MEAVVNLYQEVMKHADPRIQGYPLMGSPLLMTSILLTYVYFVLSLGPRIMANRKPFQLRGFMIVYNFSLVALSLYIVYEFLMSGWLSTYTWRCDPVDYSNSPEALRMVRVAWLFLFSKFIELMDTVIFILRKKDGQVTFLHVFHHSVLPWSWWWGVKIAPGGMGSFHAMINSSVHVIMYLYYGLSAFGPVAQPYLWWKKHMTAIQLIQFVLVSLHISQYYFMSSCNYQYPVIIHLIWMYGTIFFMLFSNFWYHSYTKGKRLPRALQQNGAPGIAKVKANX

SEQ ID NO: 416 - protein, 284 aa, Homo sapiens
  SITE (2): Xaa equals any of the naturally occurring L-amino acids
  SITE (22): Xaa equals any of the naturally occurring L-amino acids
  SITE (284): Xaa equals stop translation
MXLWPQTCSGKFDGTLAFSIHXLAVILGDQLTAADLVPIFNGFLKDLDEVRIGVLKHLHDFLKLLHIDKRREYLYQLQEFLVTDNSRNWRFRAELAEQLILLLELYSPRDVYDYLRPIALNLCADKVSSVRWISYKLVSEMVKKLHAATPPTFGVDLINELVENFGRCPKWSGRQAFVFVCQTVIEDDCLPMDQFAVHLMPHLLTLANDRVPNVRVLLAKTLRQTLLEKDYFLASASCHQEAVEQTIMALQMDRDSDVKYFASIHPASTKISEDAMSTASSTYX

SEQ ID NO: 417 - protein, 187 aa, Homo sapiens
  SITE (34): Xaa equals any of the naturally occurring L-amino acids
  SITE (144): Xaa equals any of the naturally occurring L-amino acids
  SITE (145): Xaa equals any of the naturally occurring L-amino acids
MLFLFFVIIFLFVFLILIIQFSKPLTNPHPPAGXSDRRRRYSSYRSHDHYQRQRVLQKERAIEERRVVFIGKIPGRMTRSELKQRFSVFGEIEECTIHFRVQGDNYGFVTYRYAEEAFAAIESGHKLRQADEQPFDLCFGGRRXXCKRSYSDLDSNREDFDPAPVKSKFDSLDFDTLLKQAQKNLRR

SEQ ID NO: 418 - protein, 237 aa, Homo sapiens
  SITE (197): Xaa equals any of the naturally occurring L-amino acids
  SITE (198): Xaa equals any of the naturally occurring L-amino acids
  SITE (200): Xaa equals any of the naturally occurring L-amino acids
  SITE (202): Xaa equals any of the naturally occurring L-amino acids
  SITE (204): Xaa equals any of the naturally occurring L-amino acids
  SITE (205): Xaa equals any of the naturally occurring L-amino acids
  SITE (207): Xaa equals any of the naturally occurring L-amino acids
  SITE (208): Xaa equals any of the naturally occurring L-amino acids
  SITE (211): Xaa equals any of the naturally occurring L-amino acids
  SITE (212): Xaa equals any of the naturally occurring L-amino acids
  SITE (213): Xaa equals any of the naturally occurring L-amino acids
  SITE (214): Xaa equals any of the naturally occurring L-amino acids
  SITE (215): Xaa equals any of the naturally occurring L-amino acids
  SITE (216): Xaa equals any of the naturally occurring L-amino acids
  SITE (217): Xaa equals any of the naturally occurring L-amino acids
  SITE (218): Xaa equals any of the naturally occurring L-amino acids
  SITE (219): Xaa equals any of the naturally occurring L-amino acids
  SITE (221): Xaa equals any of the naturally occurring L-amino acids
  SITE (222): Xaa equals any of the naturally occurring L-amino acids
  SITE (223): Xaa equals any of the naturally occurring L-amino acids
  SITE (224): Xaa equals any of the naturally occurring L-amino acids
  SITE (226): Xaa equals any of the naturally occurring L-amino acids
  SITE (227): Xaa equals any of the naturally occurring L-amino acids
  SITE (228): Xaa equals any of the naturally occurring L-amino acids
  SITE (237): Xaa equals stop translation
MKLPGKFRRAHQGNLESQLTSESYYKETLSVPTVEHIIQELKDIFSEQHLKALKCLSLVPSVMGQLKFNTSEEHHADMYRSDLPNPDTLSAELHCWRIKWKHRGKDIELPSTIYEALHLPDIKFFPNVYALLKVLCILPVMKVENERYENGRKRLKAYLRNTLTDQRSSNLALLNINFDIKHDLDLMVDTYIKLYTXXSXLXTXXSXXVEXXXXXXXXXGXXXXDXXXREKAVRCMX

SEQ ID NO: 419 - protein, 192 aa, Homo sapiens
  SITE (192): Xaa equals stop translation
MKPMAVVASTVLGLVQNMRAFGGILVVVYYVFAIIGINLFRGVIVALPGNSSLAPANGSAPCGSFEQLEYWANNFDDFAAALVTLWNLMVVNNWQVFLDAYRRYSGPWSKIYFVLWWLVSSVIWVNLFLALILENFLHKWDPRSHLQPLAGTPEATYQMTVELLFRDILEEPGEDELTERLSQHPHLWLCRX

SEQ ID NO: 420 - protein, 21 aa, Homo sapiens
NVVVVAFGLILIIESLGEQCP

SEQ ID NO: 421 - protein, 51 aa, Homo sapiens
  SITE (51): Xaa equals stop translation
MNWGLSIWLHYYEKKKEQVFLVILAHVVRRCASDGILQFESSLLKMRRAPX

SEQ ID NO: 422 - protein, 32 aa, Homo sapiens
MLIISLRPQFPSLIVQLECSVLFLPISLNLLL

SEQ ID NO: 423 - protein, 163 aa, Homo sapiens
  SITE (163): Xaa equals stop translation
MVKVCNDSDRWSLISLSNNSGKNVELKFVDSLRRQFEFSVDSFQIKLDSLLLFYECSENPMTETFHPTIIGESVYGDFQEAFDHLCNKIIATRNPEEIRGGGLLKYCNLLVRGFRPASDEIKTLQRYMCSRFFIDFSDIGEQQRKLESYLQNHFVGIGRPQVX

SEQ ID NO: 424 - protein, 174 aa, Homo sapiens
  SITE (174): Xaa equals stop translation
MAPKGKVGTRGKKQIFEENRETLKFYLRIILGANAIYCLVTLVFFYSSASFWAWLALGFSLAVYGASYHSMSSMARAAFSEDGALMDGGMDLNMEQGMAEHLKDVILLTAIVQVLSCFSLYVWSFWLLAPGRALYLLWVNVLGPWFTADSGTPAPEHNEKRQRRQERRQMKRLX

SEQ ID NO: 425 - protein, 50 aa, Homo sapiens
  SITE (50): Xaa equals stop translation
MELPKGLQGVGPVAMMRPFYLLLPVLCTQALRQSQGKSPLLWKRTCCLAX

SEQ ID NO: 426 - protein, 120 aa, Homo sapiens
  SITE (96): Xaa equals any of the naturally occurring L-amino acids
MLGKGGGRAGLLRYRLLYFTLVVGEGEPGENKVTIPFFETGKKIIFCSVKMVENSNVPSHKGPVPLRSEQWELKISETLGEGKIGFLLIGRCSSGXGGLCFCWDVLCCMYAYMDRSLLSL

SEQ ID NO: 427 - protein, 159 aa, Homo sapiens
  SITE (159): Xaa equals stop translation
MTHLLLTATVTPSEQNSSREPGWETAMAKDILGEAGLHFDELNKLRVLDPEVTQQTIELKEECKDFVDKIGQFQKIVGGLIELVDQLAKEAENEKMKAIGARNLLKSIAKQREAQQQQLQALIAEKKMQLERYRVEYEALCKVEAEQNEFIDQFIFQKX

SEQ ID NO: 428 - protein, 154 aa, Homo sapiens
  SITE (154): Xaa equals stop translation
MNVGVAHSEVNPNTRVMNSRGMWLTYALGVGLLHIVLLSIPFFSVPVAWTLTNIIHNLGMYVFLHAVKGTPFETPDQGKARLLTHWEQLDYGVQFTSSRKFFTISPIILYFLASFYTKYDPTHFILNTASLLSVLIPKMPQLHGVRIFGINKYX

SEQ ID NO: 429 - protein, 204 aa, Homo sapiens
MVCGGFACSKNCLCALNLLYTLVSLLLIGIAAWGIGFGLISSLRVVGVVIAVGIFLFLIALVGLIGAVKHHQVLLFFYMIILLLVFIVQFSVSCACLALNQEQQGQLLEVGWNNTASARNDIQRNLNCCGFRSVNPNDTCLASCVKSDHSCSPCAPIIGEYAGEVLRFVGGIGLFFSFTEILGVWLTYRYRNQKDPRANPSAFL

SEQ ID NO: 430 - protein, 67 aa, Homo sapiens
  SITE (67): Xaa equals stop translation
MLQSIIKNIWIPMKPYYTKVYQEIWIGMGLMGFIVYKIRAADKRSKALKASAPAPGHHNQIYLEYMX

SEQ ID NO: 431 - protein, 25 aa, Homo sapiens
MLGVSLFLLVVLYHYVAVNNPKKQE

SEQ ID NO: 432 - protein, 299 aa, Homo sapiens
  SITE (4): Xaa equals any of the naturally occurring L-amino acids
  SITE (254): Xaa equals any of the naturally occurring L-amino acids
  SITE (255): Xaa equals any of the naturally occurring L-amino acids
  SITE (299): Xaa equals stop translation
MAAXEPAVLALPNSGAGGAGAPSGTVPVLFCFSVFARPSSVPHGAGYELLIQKFLSLYGDQIDMHRKFVVQLFAEEWGQYVDLPKGFAVSERCKVRLVPLQIQLTTLGNLTPSSTVFFCCDMQERFRPAIKYFGDIISVGQRLLQGARILGIPVIVTEQYPKGLGSTVQEIDLTGVKLVLPKTKFSMVLPEVEAALAEIPGVRSVVLFGVETHVCIQQTALELVGRGVEVHIVADATSSRSMMDRMFALERLAXXGIIVTTSEAVLLQLVADKDHPKFKEIQNLIKASAPESGLLSKVX

SEQ ID NO: 433 - protein, 86 aa, Homo sapiens
MQSSYIISGCLFSILFPLFIISANEAKTPGKAYLFQLRLFSLVVFLSNRLFHKTVYLQSALSSSTSAEKFPSPHPSPAKLKATAGH

SEQ ID NO: 434 - protein, 198 aa, Homo sapiens
  SITE (193): Xaa equals any of the naturally occurring L-amino acids
  SITE (196): Xaa equals any of the naturally occurring L-amino acids
  SITE (198): Xaa equals stop translation
MFGCLVAGRLVQTAAQQVAEDKFVFDLPDYESINHVVVFMLGTIPFPEGMGGSVYFSYPDSNGMPVWQLLGFVTNGKPSAIFKISGLKSGEGSQHPFGAMNIVRTPSVAQIGISVELLDSMAQQTPVGNAAVSSVDSFTQFTQKMLDNFYNFASSFAVSQAQMTPSPSEMFIPANVVLKWYENFQRRLAQNPXFWXTX

SEQ ID NO: 435 - protein, 47 aa, Homo sapiens
  SITE (47): Xaa equals stop translation
MGLPLMALMWSTLPASAGVNFILALPLLLLWKNRGGVGRSVMSAVEX

SEQ ID NO: 436 - protein, 370 aa, Homo sapiens
  SITE (370): Xaa equals stop translation
MKKVEEKRVDVNSAVAMGEVILAVCHPDCITTIKHWITIIRARFEEVLTWAKQHQQRLETALSELVANAELLEELLAWIQWAETTLIQRDQEPIPQNIDRVKALIAEHQTFMEEMTRKQPDVDRVTKTYKRKNIEPTHAPFIEKSRSGGRKSLSQPTPPPMPILSQSEAKNPRINQLSARWQQVWLLALERQRKLNDALDRLEELKEFANFDFDVWRKKYMRWMNHKKSRVMDFFRRIDKDQDGKITRQEFIDGILASKFPTTKLEMTAVADIFDRDGDGYIDYYEFVAALHPNKDAYRPTTDADKIEDEVTRQVAQCKCAKRFQVEQIGENKYRFFLGNQFGDSQQLRLVRILRNRDGSRWWRMDGLGX

SEQ ID NO: 437 - protein, 30 aa, Homo sapiens
  SITE (8): Xaa equals any of the naturally occurring L-amino acids
MNVKTFSXDHMHFLCCLYLRYVTFVYLNLF

SEQ ID NO: 438 - protein, 24 aa, Homo sapiens
MEPHLRCRVTRVRGSLGNTGRWLL

SEQ ID NO: 439 - protein, 53 aa, Homo sapiens
  SITE (24): Xaa equals any of the naturally occurring L-amino acids
MHYLVLGGLGVFLFFSCFVFLFFXFSFAFFPFYLEGMGGSGNREVGGGFCLFF

SEQ ID NO: 440 - protein, 176 aa, Homo sapiens
  SITE (176): Xaa equals stop translation
MVSKALLRLVSAVNRRRMKLLLGIALLAYVASVWGNFVNMRSIQENGELKIESKIEEMVEPLREKIRDLEKSFTQKYPPVKFLSEKDRKRILITGGAGFVGSHLTDKLMMDGHEVTVVDNFFTGRKRNVEHWIGHENFELINHDVWSPSTSRLTRYTIWHLQPPLQTTCIILSRHX

SEQ ID NO: 441 - protein, 77 aa, Homo sapiens
MLRCWPLFWLPLVSPFCSLFWLLVEWFGTNIDRESYDAIGGPSWMTASSFCLSNSNIWSLEISSGSTSVVHSQQAMD

SEQ ID NO: 442 - protein, 32 aa, Homo sapiens
MRSCEIQLCVWLLVSSHVDMVLGGSPSTLYMM

SEQ ID NO: 443 - protein, 30 aa, Homo sapiens
MVVNSLCFLSLLLVILELSTDSSARLLYHE

SEQ ID NO: 444 - protein, 69 aa, Homo sapiens [sequence omitted]

SEQ ID NO: 445 - protein, 63 aa, Homo sapiens
MVTGVNPPLPPQLQHPRPINQLGSGSFFFSSFVMLRFKMCVLHCYRLLFCLIKDFSPTFVWTH

SEQ ID NO: 446 - protein, 43 aa, Homo sapiens
  SITE (43): Xaa equals stop translation
MKFSLVLLIKIISFERLLIFLFPLSFLPNIWRRVMVNLNILFX

SEQ ID NO: 447 - protein, 33 aa, Homo sapiens
MLLFPSLLFAATYNVANPSRLILYMISAGADSQ

SEQ ID NO: 448 - protein, 53 aa, Homo sapiens
  SITE (48): Xaa equals any of the naturally occurring L-amino acids
MWQVRGLPPVPLLLTMSPPPCLSSPFPFISVPLFEAVPISVSDQPSPXLTTLL

SEQ ID NO: 449 - protein, 64 aa, Homo sapiens [sequence omitted]

SEQ ID NO: 450 - protein, 34 aa, Homo sapiens
MLYSCEPYLIILNIYSQKAFYFYFFEGSFSVCTL

SEQ ID NO: 451 - protein, 89 aa, Homo sapiens
MRQRQAACQPPPSRNGLAQECPPHIPSSFFLVKLLFIPWLASLLSSPLNLLLLVSISWDLGLKLNLQQCRQHQVLQEKNTKKFNKKKKK

SEQ ID NO: 452 - protein, 350 aa, Homo sapiens
MDFITSTAILPLLFGCLGVFGLFRLLQWVRGKAYLRNAVVVITGATSGLGKECAKVFYAAGAKLVLCGRNGGALEELIRELTASHATKVQTHKPYLVTFDLTDSGAIVAAAAEILQCFGYVDILVNNAGISYRGTIMDTTVDVDKRVMETNYFGPVALTKALLPSMIKRRQGHIVAISSIQGKMSIPFRSAYAASKHATQAFFDCLRAEMEQYEIEVTVISPGYIHTNLSVNAITADGSRYGVMDTTTAQGRSPVEVAQDVLAAVGKKKKDVILADLLPSLAVYLRTLAPGLFFSLMPPGPEKSGNPRTPSTLTSQGQGREAALLGLLTLQGTVAFVETLMEICLTSGKD

SEQ ID NO: 453 - protein, 49 aa, Homo sapiens [sequence omitted]

SEQ ID NO: 454 - protein, 278 aa, Homo sapiens
  SITE (194): Xaa equals any of the naturally occurring L-amino acids
  SITE (278): Xaa equals stop translation
MASAELDYTIEIPDQPCWSQKNSPSPGGKEAETRQPVVILLGWGGCKDKNLAKYSAIYHKRGCIVIRYTAPWHMVFFSESLGIPSLRVLAQKLLELLFDYEIEKEPLLFHVFSNGGVMLYRYVLELLQTRRFCRLRVVGTIFDSAPGDSNLVGALRALAAILERRAAMLRLLLLVAFALVVVLFHVLLAPITAXFHTHFYDRLQDAGSRWPELYLYSRADEVVLARDIERMVEARLARRVLARSVDFVSSAHVSHLRDYPTYYTSLCVDFMRNCVRCX

SEQ ID NO: 455 - protein, 199 aa, Homo sapiens
  SITE (199): Xaa equals stop translation
MSFIFDWIYSGFSSVLQFLGLYKKTGKLVFLGLDNAGKTTLLHMLKDDRLGQHVPTLHPTSEELTIAGMTFTTFDLGGHVQARRVWKNYLPAINGIVFLVDCADHERLLESKEELDSLMTDETIANVPILILGNKIDRPEAISEERLREMFGLYGQTTGKGSISLKELNARPLEVFMCSVLKRQGYGEGFRWMAQYIDX

SEQ ID NO: 456 - protein, 258 aa, Homo sapiens
  SITE (170): Xaa equals any of the naturally occurring L-amino acids
  SITE (219): Xaa equals any of the naturally occurring L-amino acids
  SITE (258): Xaa equals stop translation
MTLSRFAYNGKRCPSSYNILDNSKIISEECRKELTALLHHYYPIEIDPHRTVKEKLPHMVEWWTKAHNLLCQQKIQKFQIAQVVRESNAMLREGYKTFFNTLYHNNIPLFIFSAGIGDILEEIIRQMKVFHPNIHIVSNYMDFNEDGFLQGFKGQLIHTYNKNSSVCENXGYFQQLEGKTNVILLGDSIGDLTMADGVPGVQNILKIGFLNDKVEERRXRYMDSYDIVLEKDETLDVVNGLLQHILCQGVQLEMQGPX

SEQ ID NO: 457 - protein, 87 aa, Homo sapiens
  SITE (82): Xaa equals any of the naturally occurring L-amino acids
MSHVLLCPSLSCSNLLPPSHSLGTMGSLSPHLCGHTMCPVNPELPLSSRLTTDQPQPDACSPTLLTLPLPSSFLPHSKPTFXHPCSP

SEQ ID NO: 458 - protein, 315 aa, Homo sapiens
  SITE (28): Xaa equals any of the naturally occurring L-amino acids
  SITE (315): Xaa equals stop translation
MFSINPLENLKVYISSRPPLVVFMISVXPMAIAFLTLGYFFKIKEIKSPEMAEDWNTFLLRFNDLDLCVSENETLKHLTNDTTTPESTMTSGQARASTQSPQALEDSGPVNISVSITLTLDPLKPFGGYSRNVTHLYSTILGHQIGLSGREAHEEINITFTLPTAWSSDDCALHGHCEQVVFTACMTLTASPGVFPVTVQPPHCVPDTYSNATLWYKIFTTARDANTKYAQDYNPFWCYKGAIGKVYHALNPKLTVIVPDDDRSLINLHLMHTSYFLFVMVITMFCYAVIKGRPSKLRQSNPEFCPEKVALAEAX

SEQ ID NO: 459 - protein, 52 aa, Homo sapiens
MPGLSLALLPFGPGCTEALHAGCFPAFASATRVNGEAALSPGLCDPISVPYV

SEQ ID NO: 460 - protein, 383 aa, Homo sapiens
  SITE (383): Xaa equals stop translation
MAVGQIMTFGSPVIGCGFISGWNLVSMCVEYVLLWKVYQKTPALAVKAGLKEEETELKQLNLHKDTEPKPLEGTHLMGVKDSNIHELEHEQEPTCASQMAEPFRTFRDGWVSYYNQPVFLAGMGLAFLYMTVLGFDCITTGYAYTQGLSGFHPQYFDGSISYNWNNGNCSFYLATSKMWFGSAGLISGLAQLSCLILCVISVFMPGSPLDLSVSPFEDIRSRFIQGESITPTKIPEITTEIYMSNGSNSANIVPETSPESVPIISVSLLFAGVIAARIGLWSFDLTVTQLLQENVIESERGIINGVQNSMNYLLDLLHFIMVILAPNPEAFGLLVLISVSFVAMGHIMYFRFAQNTLGNKLFACGPDAKEVRKENQANTSVVX

SEQ ID NO: 461 - protein, 186 aa, Homo sapiens [sequence omitted]

SEQ ID NO: 462 - protein, 163 aa, Homo sapiens
  SITE (163): Xaa equals stop translation
MLQTSNYSLVLSLQFLLLSYDLFVNSFSELLQKTPVIQLVLFIIQDIAVLFNIIIIFLMFFNTFVFQAGLVNLLFHKFKGTIILTAVYFALSISLHVWVMNLRWKNSNSFIWTDGLQMLFVFQRLAAVLYCYFYKRTAVRLGDPHFYQDSLWLRKEFMQVRRX

SEQ ID NO: 463 - protein, 46 aa, Homo sapiens [sequence omitted]

SEQ ID NO: 464 - protein, 105 aa, Homo sapiens
  SITE (105): Xaa equals stop translation
MSYLAFLYMTFDFCCLYFSTVYAPSFKYICVHTDTHICVCVCIYLSSVVSKSSAEADGVLQPRRHPASLLIVFATSISESSLLIFSFQKTEAKLIVFAVSLAAKX

SEQ ID NO: 465 - protein, 70 aa, Homo sapiens
  SITE (70): Xaa equals stop translation
MLPPFSLVYTHFLVASLLPVILAVFPDSAQIVPLLKPIPRPQPEVIFPSSELLEQLLSVQFVWQAHTVAX

SEQ ID NO: 466 - protein, 155 aa, Homo sapiens
  SITE (155): Xaa equals stop translation
MALLLSVLRVLLGGFFALVGLAKLSEEISAPVSERMNALFVQFAEVFPLKVFGYQPDPLNYQIAVGFLELLAGLLLVMGPPMLQEISNLFLILLMMGAIFTLAALKESLSTCIPAIVCLGFLLLLNVGQLLAQTKKVVRPTRKKTLSTFKESWKX

SEQ ID NO: 467 - protein, 332 aa, Homo sapiens
MKLGRAVLGLLLLAPSVVQAVEPISLGLALAGVLTGYIYPRLYCLFAECCGQKRSLSREALQKDLDDNLFGQHLAKKIILNAVFGFINNPKPKKPLTLSLHGWTGTGKNFVSKIIAENIYEGGLNSDYVHLFVATLHFPHASNITLYKDQLQLWIRGNVSACARSIFIFDEMDKMHAGLIDAIKPFLDYYDLVDGVSYQKAMFIFLSNAGAERITDVALDFWRSGKQREDIKLKDIEHALSVSVFNNKNSGFWHSSLIDRNLIDYFVPFLPLEYKHLKMCIRVEMQSRGYEIDEDIVSRVAEEMTFFPKEERVFSDKGCKTVFTKLDYYYDD

SEQ ID NO: 468 - protein, 48 aa, Homo sapiens [sequence omitted]

SEQ ID NO: 469 - protein, 548 aa, Homo sapiens
  SITE (219): Xaa equals any of the naturally occurring L-amino acids
  SITE (220): Xaa equals any of the naturally occurring L-amino acids
MAKFMTPVIQDNPSGWGPCAVPEQFRDMPYQPFSKGDRLGKVADWTGATYQDKRYTNKYSSQFGGGSQYAYFHEEDESSFQLVDTARTQKTAYQRNRMRFAQRNLRRDKDRRNMLQFNLQILPKSAKQKERERIRLQKKFQKQFGVRQKWDQKSQKPRDSSVEVRSDWEVKEEMDFPQLMKMRYLEVSEPQDIECCGALEYYDKAFDRITTRSEKPLRXXKRIFHTVTTTDDPVIRKLAKTQGNVFATDAILATLMSCTRSVYSWDIVVQRVGSKLFFDKRDNSDFDLLTVSETANEPPQDEGNSFNSPRNLAMEATYINHNFSQQCLRMGKERYNFPNPNPFVEDDMDKNEIASVAYRYRSGKLGDDIDLIVRCEHDGVMTGANGEVSFINIKTLNEWDSRHCNGVDWRQKLDSQRGAVIATELKNNSYKLARWTCCALLAGSEYLKLGYVSRYHVKDSSRHVILGTQQFKPNEFASQINLSVENAWGILRCVIDICMKLEEGKYLILKDPNKQVIRVYSLPDGTFSSDEDEEEEEEEEEEEEEEET

SEQ ID NO: 470 - protein, 285 aa, Homo sapiens
  SITE (191): Xaa equals any of the naturally occurring L-amino acids
  SITE (216): Xaa equals any of the naturally occurring L-amino acids
  SITE (217): Xaa equals any of the naturally occurring L-amino acids
MKLHPPPPSPVTQDHRSKSSHSNWMPRMGACSMSRTSSSGPPSLCKSTSGRSCTRPHCWPSLPAWVSVFTRTNTGSWCYPAWGGAFSRPWMSAQSMCCAERSVLQVACRLLDALEFLHENEYVHGNVTAENIFVDPEDQSQVTLAGYGFAFRYCPSGKHVAYVEGSRSPHEGDLEFISMDLHKGCGPSRRXDLQSLGYCMLKWLYGFLPWTNCLPXXEDIMKQKQKFVDKPGPFVGPCGHWIRPSETLQKYLKVVMALTYEEKPPYAMLRNNLEALLQDLRVSPY

SEQ ID NO: 471 - protein, 80 aa, Homo sapiens
  SITE (80): Xaa equals stop translation
MTSPPPHQGWEQRGCGESQVPLALSRVFSTSHYCLLLVANQSIFFPCLWAVERLLGVRCTCPLSWGKRIISEHCSAQSSX

SEQ ID NO: 472 - protein, 47 aa, Homo sapiens
MHTWYNDRRQNCHCLLFFLIYLRKIYQVVPHVPLLVKCRGRLKGVNI

SEQ ID NO: 473 - protein, 96 aa, Homo sapiens
  SITE (96): Xaa equals stop translation
MELVLVFLCSLLAPMVLASAAEKEKEMDPFHYDYQTLRIGGLVFAVVLFSVGILLILSRRCKCSFNQKPRAPGDEEAQVENLITANATEPQKAENX

SEQ ID NO: 474 - protein, 399 aa, Homo sapiens
  SITE (399): Xaa equals stop translation
MASGADSKGDDLSTAILKQKNRPNRLIVDEAINEDNSVVSLSQPKMDELQLFRGDTVLLKGKKRREAVCIVLSDDTCSDEKIRMNRVVRNNLRVRLGDVISIQPCPDVKYGKRIHVLPIDDTVEGITGNLFEVYLKPYFLEAYRPIRKGDIFLVRGGMRAVEFKVVETDPSPYCIVAPDTVIHCEGEPIKREDEEESLNEVGYDDIGGCRKQLAQIKEMVELPLRHPALFKAIGVKPPRGILLYGPPGTGKTLIARAVANETGAFFFLINGPEIMSKLAGESESNLRKAFEEAEKNAPAIIFIDELDAIAPKREKTHGEVERRIVSQLLTLMDGLKQRAHVIVMAATNRPNSIDPALRRFGRFDREVDIGIPDATGRLEILQIHTKNMKLADDVDLEQX

SEQ ID NO: 475 - protein, 45 aa, Homo sapiens
MYMKTNLSLVSLKYLFFLTCEMFERRFSIHFSAAWRKLGNDFFQL

SEQ ID NO: 476 - protein, 273 aa, Homo sapiens
  SITE (181): Xaa equals any of the naturally occurring L-amino acids
  SITE (202): Xaa equals any of the naturally occurring L-amino acids
  SITE (203): Xaa equals any of the naturally occurring L-amino acids
  SITE (204): Xaa equals any of the naturally occurring L-amino acids
  SITE (211): Xaa equals any of the naturally occurring L-amino acids
  SITE (212): Xaa equals any of the naturally occurring L-amino acids
  SITE (214): Xaa equals any of the naturally occurring L-amino acids
  SITE (273): Xaa equals stop translation
MAAPKGSLWVRTQLGLPPLLLLTMALAGGSGTASAEAFDSVLGDTASCHRACQLTYPLHTYPKEEELYACQRGCRLFSICQFVDDGIDLNRTKLECESACTEAYSQSDEQYACHLGCQNQLPFAELRQEQLMSLMPKMHLLFPLTLVRSFWSDMMDSAQSFITSSWTFYLQADDGKIVIFXSKPRNPRYAPHLEPGALPNLXXXSLSKMSXXSXMRNSQAHRNFLEDGESDGFLRCLSLNSGWILTTTLVLSVMVLLWICCATCCYTLLDAVX

SEQ ID NO: 477 - protein, 192 aa, Homo sapiens
  SITE (129): Xaa equals any of the naturally occurring L-amino acids
MMVLSLGIILASASFSPNFTQVTSTLLNSAYPFIGPFFFIISGSLSIATEKRLTKLLVHSSLVGSILSALSALVGFIILSVKQATLNPASLQCELDKNNIPTRSYVSYFYHDSLYTTDCYTAKASLAGXLSLMLICTLLEFCLAVLTAVLRWKQAYSDFPGSVLFLPHSYIGNSGMSSKMTHDCGYEELLTS

SEQ ID NO: 478 - protein, 234 aa, Homo sapiens
MRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFSGTPGSNENSTQNVYKIPPTTTKALCPLYTSPRTVTQAPPKSTADVSTPDSEINLTNVTDIIRVPVFNIVILLAGGFLSKSLVFSVLFAVTLRSFVP

SEQ ID NO: 479 - protein, 105 aa, Homo sapiens
  SITE (105): Xaa equals stop translation
MLHILPLKSYDFPHFSLMGRYRCASLLFCFLLLFFFFCSVLWTFSDMHRSGEDGPWTPCVHHLAASLISYGQPGFICISLFSPVLFIENPRHYANATVTTLGDWX

SEQ ID NO: 480 - protein, 32 aa, Homo sapiens
MVFLKYRFLFFLVFLANCIYSLHYKPSLMYPK

SEQ ID NO: 481 - protein, 571 aa, Homo sapiens
  SITE (556): Xaa equals any of the naturally occurring L-amino acids
  SITE (571): Xaa equals stop translation
MALSRGLPRELAEAVAGGRVLVVGAGGIGCELLKNLVLTGFSHIDLIDLDTIDVSNLNRQFLFQKKHVGRSKAQVAKESVLQFYPKANIVAYHDSIMNPDYNVEFFRQFILVMNALDNRAARNHVNRMCLAADVPLIESGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQGEETNASDQQNEPQLGLKDQQVLDVKSYARLFSKSIETLRVHLAEKGDGAELIWDKDDPSAMDFVTSAANLRMHIFSMNMKSRFDIKSMAGNIIPAIATTNAVIAGLIVLEGLKILSGKIDQCRTIFLNKQPNPRKKLLVPCALDPPNPNCYVCASKPEVTVRLNVHKVTVLTLQDKIVKEKFAMVAPDVQIEDGKGTILISSEEGETEANNHKKLSEFGIRNGSRLQADDFLQDYTLLINILHSEDLGKDVEFEVVGDAPEKVGXKQAEDAAKSITNGQX

SEQ ID NO: 482 - protein, 312 aa, Homo sapiens
  SITE (312): Xaa equals stop translation
MQVVTCLTRDSYLTHCFLQHLMVVLSSLERTPSPEPVDKDFYSEFGNKTTGKMENYELIHSSRVKFTYPSEEEIGDLTFTVAQKMAEPEKAPALSILLYVQAFQVGMPPPGCCRGPLRPKTLLLTSSEIFLLDEDCVHYPLPEFAKEPPQRDRYRLDDGRRVRDLDRVLMGYQTYPQPSPSSSMTCKVMTSWAVSPWTTLGRCQVARLEPARAVKSSGRCLSPVLRAERSSSRCWLASGRPCVAVSCLSSSPASPGHSQPVVSSLTPTGAGQQAFVFSKNVLSSLWYLNLTVLAENVNMCVCCVNSFSCWEX

SEQ ID NO: 483 - protein, 329 aa, Homo sapiens
  SITE (329): Xaa equals stop translation
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQDAASKKTIYTYIMASRNTQPAESRIYDEILQSKVLPSKEEPVNTVYSEVQFADKMGKASTQDSKPPGTSSYEIVIX

SEQ ID NO: 484 - protein, 178 aa, Homo sapiens
  SITE (178): Xaa equals stop translation
MKLQCVSLWLLGTILILCSVDNHGLRRCLISTDMHHIEESFQEIKRAIQAKDTFPNVTILSTLETLQIIKPLDVCCVTKNLLAFYVDRVFKDHQEPNPKILRKISSIANSFLYMQKTLRQCQEQRQCHCRQEATNATRVIHDNYDQLEVHAAAIKSLGELDVFLAWINKNHEVMSSAX

SEQ ID NO: 485 - protein, 238 aa, Homo sapiens
  SITE (11): Xaa equals any of the naturally occurring L-amino acids
  SITE (14): Xaa equals any of the naturally occurring L-amino acids
  SITE (22): Xaa equals any of the naturally occurring L-amino acids
  SITE (63): Xaa equals any of the naturally occurring L-amino acids
  SITE (64): Xaa equals any of the naturally occurring L-amino acids
  SITE (66): Xaa equals any of the naturally occurring L-amino acids
MGRPLLLPLLXLLXPPAFLQPXGSTGSGPSYLYGVTQPKHLSASMGGSVEIPFSFYYPWELAXXPXVRISWRRGHFHGQSFYSTRPPSIHKDYVNRLFLNWTEGQESGFLRISNLRKEDQSVYFCRVELDTRRSGRQQLQSIKGTKLTITQAVTTTTTWRPSSTTTIAGLRVTESKGHSESWHLSLDTAIRVALAVAVLKTVILGLLCLLLCGGGEGKVAGRQAVTSDQQSVGRRDVY

SEQ ID NO: 486 - protein, 62 aa, Homo sapiens
MQKKNSLFFFFAFYYENKTNAPGEGSMITRNIKEYFLPFLFCCVEASIAINKLNYLHWTHFQ

SEQ ID NO: 487 - protein, 27 aa, Homo sapiens
MPGLSLILTVTLLAVSDSAATCIVAKG

SEQ ID NO: 488 - protein, 339 aa, Homo sapiens
  SITE (142): Xaa equals any of the naturally occurring L-amino acids
  SITE (330): Xaa equals any of the naturally occurring L-amino acids
  SITE (335): Xaa equals any of the naturally occurring L-amino acids
  SITE (336): Xaa equals any of the naturally occurring L-amino acids
  SITE (339): Xaa equals stop translation
MSGPDVETPSAIQICRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRXEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKXQGHAXXQPX

SEQ ID NO: 489 - protein, 32 aa, Homo sapiens
MLNSNINDLLMVTYLANLTQSQIALNEKLVNL

SEQ ID NO: 490 - protein, 48 aa, Homo sapiens
  SITE (48): Xaa equals stop translation
MRETSIRVLLMLPALESTSGLSAFMGLGTRIGCFKTITCWPTSLTQRX

SEQ ID NO: 491 - protein, 38 aa, Homo sapiens
MYMYSLNVFLSFIFLALVFKCVHVCQGANAFLFLKLVF

SEQ ID NO: 492 - protein, 61 aa, Homo sapiens
MGLRLICLELTMVKALVCEMFLFFLMTQKLIWQECTEKFAKLLVQLISLVFAWEFFSEDTP

SEQ ID NO: 493 - protein, 346 aa, Homo sapiens
  SITE (346): Xaa equals stop translation
MLAARLVCLRTLPSRVFHPAFTKASPVVKNSITKNQWLLTPSREYATKTRIGIRRGRTGQELKEAALEPSMEKIFKIDQMGRWFVAGGAAVGLGALCYYGLGLSNEIGAIEKAVIWPQYVKDRIHSTYMYLAGSIGLTALSAIAISRTPVLMNFMMRGSWVTIGVTFAAMVGAGMLVRSIPYDQSPGPKHLAWLLHSGVMGAVVAPLTILGGPLLIRAAWYTAGIVGGLSTVAMCAPSEKFLNMGAPLGVGLGLVFVSSLGSMFLPPTTVAGATLYSVAMYGGLVLFSMFLLYDTQKVIKRAEVSPMYGVQKYDPINSMLSIYMDTLNIFMRVATMLATGGNRKKX

SEQ ID NO: 494 - protein, 237 aa, Homo sapiens
  SITE (237): Xaa equals stop translation
MEEVLLLGLKDREGYTSFWNDCISSGLRGCMLIELALRGRLQLEACGMRRKSLLTRKVICKSDAPTGDVLLDEALKHVKETQPPETVQNWIELLSGETWNPLKLHYQLRNVRERLAKNLVEKGVLTTEKQNFLLFDMTTHPLTNNNIKQRLIKKVQEAVLDKWVNDPHRMDRRLLALIYLAHASDVLENAFAPLLDEQYDLATKRVRQLLDLDPEVECLKANTNEVLWAVVAAFTKX

SEQ ID NO: 495 - protein, 200 aa, Homo sapiens
  SITE (200): Xaa equals stop translation
MAQRMVWVDLEMTGLDIEKDQIIEMACLITDSDLNILAEGPNLIIKQPDELLDSMSDWCKEHHGKSGLTKAVKESTITLQQAEYEFLSFVRQQTPPGLCPLAGNSVHEDKKFLDKYMPQFMKHLHYRIIDVSTVKELCRRWYPEEYEFAPKKAASHRALDDISESIKELQFYRNNIFKKKIDEKKRKIIENGENEKTVSX

SEQ ID NO: 496 - protein, 351 aa, Homo sapiens
  SITE (351): Xaa equals stop translation
MATTAAPAGGARNGAGPEWGGFEENIQGGGSAVIDMENMDDTSGSSFEDMGELHQRLREEEVDADAADAAAAEEEDGEFLGMKGFKGQLSRQVADQMWQAGKRQASRAFSLYANIDILRPYFDVEPAQVRTGLLESMIPIKMVNFPQKIAGELYGPLMLVFTLVAILLHGMKTSDTIIREGTLMGTAIGTCFGYWLGVSSFIYFLAYLCNAQITMLQMLALLGYGLFGHCIVLFITYNIHLHALFYLFWLLVGGLSTLRMVAVLVSRTVGPTQRLLLCGTLAALHMLFLLYLHFAYHKVVEGILDTLEGPNIPPIQRVPRDIPAMLPAARLPTTVLNATAKAVAVTLQSHX

SEQ ID NO: 497 - protein, 265 aa, Homo sapiens
  SITE (265): Xaa equals stop translation
MRGSRGGWAGEMAASGESGTSGGGGSTEEAFMTFYSEVKQIEKRDSVLTSKNQIERLTRPGSSYFNLNPFEVLQIDPEVTDEEIKKRFRQLSILVHPDKNQDDADRAQKAFEAVDKAYKLLLDQEQKKRALDVIQAGKEYVEHTVKERKKQLKKEGKPTIVEEDDPELFKQAVYKQTMKLFAELEIKRKEREAKEMHERKRQREEEIEAQEKAKREREWQKNFEESRDGRVDSWRNFQANTKGKKEKKNRTFLRPPKVKMEQREX

SEQ ID NO: 498 - protein, 25 aa, Homo sapiens
  SITE (9): Xaa equals any of the naturally occurring L-amino acids
DSMPTCPLXASLECGPLLPVRLCCL

SEQ ID NO: 499 - protein, 159 aa, Homo sapiens
  SITE (159): Xaa equals stop translation
MNEYRVPELNVQNGVLKSLSFLFEYIGEMGKDYIYAVTPLLEDALMDRDLVHRQTASAVVQHMSLGVYGFGCEDSLNHLLNYVWPNVFETSPHVIQAVMGALEGLRVAIGPCRMLQYCLQGLFHPARKVRDVYWKIYNSIYIGSQDALIAHYPRIYQRX

SEQ ID NO: 500 - protein, 279 aa, Homo sapiens
  SITE (238): Xaa equals any of the naturally occurring L-amino acids
  SITE (279): Xaa equals stop translation
MISDNSAENIALVTSMYDGLLQAGARLCPTVQLEDIRNLQDLTPLKLAAKEGKIEIFRHILQREFSGLSHLSRKFTEWCYGPVRVSLYDLASVDSCEENSVLEIIAFHCKSPHRHRMVVLEPLNKLLQAKWDLLIPKFFLNFLCNLIYMFIFTAVAYHQPTLKKQAAPHLKAEVGNSMLLTGHILILLGGIYLLVGQLWYFWRRHVFIWISFIDSYFEILFLFQALLTVVSQVLCFLXIEWYLPLLVSALVLGWLNLLYYTRGFQHTGIYSVMIQKPWX

SEQ ID NO: 501 - protein, 193 aa, Homo sapiens
  SITE (143): Xaa equals any of the naturally occurring L-amino acids
MIRCGLACERCRWILPLLLLSAIAFDIIALAGRGWLQSSDHGQTSSLWWKCSQEGGGSGSYEEGCQSLMEYAWGRAAAAMLFCGFIILVICFILSFFALCGPQMLVFLRVIGGLLALAAVFQIISLVIYPVKYTQTFTLHANXAVTYIYNWAYGFGWAATIILIGCAFFFCCLPNYEDDLLGNAKPRYFYTSA

SEQ ID NO: 502 - protein, 205 aa, Homo sapiens
  SITE (15): Xaa equals any of the naturally occurring L-amino acids
  SITE (55): Xaa equals any of the naturally occurring L-amino acids
  SITE (113): Xaa equals any of the naturally occurring L-amino acids
  SITE (205): Xaa equals stop translation
MAAGDQVFSGAGHVXEHVAGGRHAWLLTWQSACPANRLSLVPLVPSASMTRLMRXRTASGSSVILWMAPAAAPTPARAPEAAPTPARAPAAARTPARGPTWTSPPTRVLLGTXPGPSPWRSPARRPAQLPPPDSDLCSGPLLPGPFSPPACHTAPNSVLIQSLFCKSELWWRQMRSITWVPSPKAGWRWTKGRKQASPHRILFHX

SEQ ID NO: 503 - protein, 147 aa, Homo sapiens
  SITE (147): Xaa equals stop translation
MALTLLPSVSRLPGERMAASGLPYVLHHKSSLMKVIFFPYPVLPLPAPNGTWVPRLVLGLGSGDQVHYLPISSSIVNYGTSVSGKSWVFLVYPLHPTPTWSTRCFQVWDLLSVELPDKGEGNTRRASGVPGLSQLPTSHKPIKQEYX

SEQ ID NO: 504 - protein, 64 aa, Homo sapiens
  SITE (64): Xaa equals stop translation
MVWVLWSAPSLAPPWVGPCWPSTGNCCLCEVGAALPPRGPSLSDCLGLPPWTPWGPAWTLAQSX

SEQ ID NO: 505 - protein, 94 aa, Homo sapiens
  SITE (94): Xaa equals stop translation
MSTGALNTSPPASNRLESTLNEYLIQPQLHCSSVQRLTLKWGCSSLQRDGQAVPWGLWQRAYPSLLPTLPSDLLRPHAVTPSVSVSVHTCESSX

SEQ ID NO: 506 - protein, 22 aa, Homo sapiens
MFLIFVYFLKILFSSSLPFLWL

SEQ ID NO: 507 - protein, 22 aa, Homo sapiens
  SITE (11): Xaa equals any of the naturally occurring L-amino acids
MFLIFVYFLKXLFSSSLPFLWL

SEQ ID NO: 508 - protein, 33 aa, Homo sapiens [sequence omitted]

SEQ ID NO: 509 - protein, 28 aa, Homo sapiens
MQFLLTAFLLVPLLALCDVPISLGFSPS

SEQ ID NO: 510 - protein, 15 aa, Homo sapiens
PGKPQACPELTSVLP

SEQ ID NO: 511 - protein, 27 aa, Homo sapiens
MTFTLGDSQVLLINLFPSMPSGSCARP

SEQ ID NO: 512 - protein, 19 aa, Homo sapiens
  SITE (5): Xaa equals any of the naturally occurring L-amino acids
  SITE (18): Xaa equals any of the naturally occurring L-amino acids
NKSLXSCLFVLHFVLHCXF

SEQ ID NO: 513 - protein, 29 aa, Homo sapiens
MEKTHRLRIRNPCLQFSILNLFLLKMIVS

SEQ ID NO: 514 - protein, 75 aa, Homo sapiens
  SITE (75): Xaa equals stop translation
MVDISKMHMILYDLQQNLSSSHRALEKQIDTLAGKLDALTELLSTALGPSSFQNPASSPSSWTHEEEPGYFPQYX

SEQ ID NO: 515 - protein, 10 aa, Homo sapiens
LPLAELKNWV

SEQ ID NO: 516 - protein, 207 aa, Homo sapiens
  SITE (122): Xaa equals any of the naturally occurring L-amino acids
  SITE (207): Xaa equals stop translation
MLWFGGCSAVNATGHLSDTLWLIPITFLTIGYGDVVPGTMWGKIVCLCTGVMGVCCTALLVAVVARKLEFNKAEKHVHNFMMDIQYTKEMKESAARVLQEAWMFYKHTRRKESHAARRHQRXLLAAINAFRQVRLKHRKLREQVNSMVDISKMHMILYDLQQNLSSSHRALEKQIDTLAGKLDALTELLSTALGPRQLPEPSQQSKX

SEQ ID NO: 517 - protein, 36 aa, Homo sapiens
  SITE (34): Xaa equals any of the naturally occurring L-amino acids
MWRCRGKLSFPLFAVVIVSCRKDGPDAAAAPAVXKK

SEQ ID NO: 518 - protein, 19 aa, Homo sapiens
  SITE (13): Xaa equals any of the naturally occurring L-amino acids
MALVALFTQLMRXLGRCPQ

SEQ ID NO: 519 - protein, 32 aa, Homo sapiens
MTFPFEKENSCFQCLLFDSWREQTRTNIQPQR

SEQ ID NO: 520 - protein, 28 aa, Homo sapiens
MHLLDFFRDLVLLVLLALLDSFWLEVQK

SEQ ID NO: 521 - protein, 26 aa, Homo sapiens
MCLIHFIKIILVFILKLWLYSQKCPK

SEQ ID NO: 522 - protein, 33 aa, Homo sapiens
MIHVHEWNDQMLMVYIFLYPVSITFLNLCSLTC

SEQ ID NO: 523 - protein, 47 aa, Homo sapiens
  SITE (17): Xaa equals any of the naturally occurring L-amino acids
  SITE (28): Xaa equals any of the naturally occurring L-amino acids
LNESYVSRAGGWFSMFXLIFFLLALGSXLCLLLCLPSFNKTRRKQKP

SEQ ID NO: 524 - protein, 43 aa, Homo sapiens
SSKTPLPSERRWISGSSLMAPRPWLLGIALLGLWALEPALGHW

SEQ ID NO: 525 - protein, 3 aa, Homo sapiens
LNW

SEQ ID NO: 526 - protein, 174 aa, Homo sapiens
FAFCAELMIQNWTLGAVDSQMDDMDMDLDKEFLQDLKELKVLVADKDLLDLHKSLVCTALRGKLGVFSEMEANFKNLSRGLVNVAAKLTHNKDVRDLFVDLVEKFVEPCRSDHWPLSDVRFFLNQYSASVHSLDGFRHQASGTATWAPSAAASCACIMTEVPPNAPPTLTIKLL

SEQ ID NO: 527 - protein, 43 aa, Homo sapiens
MWKNLGSGSVFVTWFSLVMILSGIGPLGDAEDSISDVSHRLRP

SEQ ID NO: 528 - protein, 13 aa, Homo sapiens
FQFPLLTIALQFL

SEQ ID NO: 529 - protein, 30 aa, Homo sapiens
MHYVIVLSLFVVLEKKNKMGSDGCLRKNGS

SEQ ID NO: 530 - protein, 3 aa, Homo sapiens
MKT

SEQ ID NO: 531 - protein, 47 aa, Homo sapiens
  SITE (45): Xaa equals any of the naturally occurring L-amino acids
MSRSIVLRGSLFLFFSHYTLKLLSVIKQTNRKIVWEKPCIRLFYXVL

SEQ ID NO: 532 - protein, 26 aa, Homo sapiens
MPLPVLLCLTLPMPLPSATARGGNRT

SEQ ID NO: 533 - protein, 58 aa, Homo sapiens
SSIPVSILIGMKLILYLLITESGSHEKKSFYPSFKYMFKIIIYVSAYCRTALRATVSH

SEQ ID NO: 534 - protein, 19 aa, Homo sapiens
NRTLLFLILFVLFGLGYGF

SEQ ID NO: 535 - protein, 40 aa, Homo sapiens
MFLLVLSVFCDFMCSIAPRCHALSLVSLRAQHLSLFITCH

SEQ ID NO: 536 - protein, 57 aa, Homo sapiens
MLLFILLTLSSGCRLLVSSWKTFLPHFSLPGPREHPEGSRTWFFRYWEPGAHCLHCA

SEQ ID NO: 537 - protein, 21 aa, Homo sapiens
ARLLLFLSSVHPSIMPSCNQL

SEQ ID NO: 538 - protein, 39 aa, Homo sapiens
MSLTSSLTFLSHILLLPQKLQFLSWMERQQRCTGVAKYA

SEQ ID NO: 539 - protein, 128 aa, Homo sapiens
  SITE (36): Xaa equals any of the naturally occurring L-amino acids
MVLRLIQLIFLIFFIHIIILLIPGSRPCGSWVNDRXLGLRDVTHLIYLHWVHGHLPWCHPYIQVEFSALIESTAQLGLPFSWVRVIHPFLVLPCLYSPGLKNGIFLFLLRAMPGGMFPGNLEAFRVPV

SEQ ID NO: 540 - protein, 82 aa, Homo sapiens
  SITE (37): Xaa equals any of the naturally occurring L-amino acids
MGSSVLPFCVCVTSPSLGGRCIQGRFASHSKFWGFGXKTASFGAVGETPPDQEPQKETEPATSSHARPWARVIGLRIWPQPN

SEQ ID NO: 541 - protein, 21 aa, Homo sapiens
  SITE (21): Xaa equals stop translation
MLLSVAIFILLTLVYAYWTMX

SEQ ID NO: 542 - protein, 20 aa, Homo sapiens
MLLSVAIFILLTLVYAYWTM

SEQ ID NO: 543 - protein, 75 aa, Homo sapiens
NCEILEYCYYLTQLKISMGKYLSIPTVLLKIIRCSITAVSDSSTSWAIKAQLKIENKDLDNKTAKGGGQEALTCT

SEQ ID NO: 544 - protein, 60 aa, Homo sapiens
  SITE (28): Xaa equals any of the naturally occurring L-amino acids
  SITE (45): Xaa equals any of the naturally occurring L-amino acids
MFLMRMHLCFCKYCCSFIVTPTSTSNTXSYLWPWISASMAGRGSXWACTLNAVTREGLPE

SEQ ID NO: 545 - protein, 39 aa, Homo sapiens
MSLLNTHTLCFVLFCFTLSINQEKLANHLAFRILFFIVF

SEQ ID NO: 546 - protein, 2 aa, Homo sapiens
ML

SEQ ID NO: 547 - protein, 36 aa, Homo sapiens [sequence omitted]

SEQ ID NO: 548 - protein, 14 aa, Homo sapiens
MFDFLSYFKDLLSC

SEQ ID NO: 549 - protein, 18 aa, Homo sapiens
  SITE (15): Xaa equals any of the naturally occurring L-amino acids
MGFGFVLNIFSFFLXPPL

SEQ ID NO: 550 - protein, 269 aa, Homo sapiens
  SITE (260): Xaa equals any of the naturally occurring L-amino acids
  SITE (266): Xaa equals any of the naturally occurring L-amino acids
MSAGEVERLVSELSGGTGGDEEEEWLYGDENEVERPEEENASANPPSGIEDETAENGVPKPKVTETEDDSDSDSDDDEDDVHVTIGDIKTGAPQYGSYGTAPVNLNIKTGGRVYGTTGTKVKGVDLDAPGSINGVPLLEVDLDSFEDKPWRKPGADLSDYFNYGFNEDTWKAYCEKQKRIRMGLEVIPVTSTTNKITVQQGRTGNSEKETALPSTKAEFTSPPSLFKTGLPPSRNSTSSQSQTSTASRKAISSVGEVGRXDMGGPXHLI

SEQ ID NO: 551 - protein, 11 aa, Homo sapiens
  SITE (9): Xaa equals any of the naturally occurring L-amino acids
  SITE (11): Xaa equals any of the naturally occurring L-amino acids
LLLWTLLAXYX

SEQ ID NO: 552 - protein, 108 aa, Homo sapiens
  SITE (108): Xaa equals stop translation
MAAQKDQQKDAEAEGLSGTTLLPKLIPSGAGREWLERRRATIRPWSTFVDQQRFSRPRNLGELCQRLVRNVEYYQSNYVFVFLGLILYCVVTSPMLLVALAVFFGACX

SEQ ID NO: 553 - protein, 106 aa, Homo sapiens
FVFLGLILYCVVTSPMLLVALAVFFGACYILYLRTLESKLVLFGREVSPAHQYALAGGISFPFFWLAGAGSAVFWVLGATLVVIGSHAAFHQIEAVDGEELQMEPV

SEQ ID NO: 554 - protein, 136 aa, Homo sapiens
  SITE (136): Xaa equals stop translation
MDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRTGCSASSTLPFRWAVVWATLQAPKX

SEQ ID NO: 555 - protein, 424 aa, Homo sapiens
  SITE (136): Xaa equals any of the naturally occurring L-amino acids
  SITE (271): Xaa equals any of the naturally occurring L-amino acids
  SITE (331): Xaa equals any of the naturally occurring L-amino acids
  SITE (364): Xaa equals any of the naturally occurring L-amino acids
  SITE (383): Xaa equals any of the naturally occurring L-amino acids
MAGDWHWALRVTPGLGVVAVLLLFLVVREPPRGAVERHSDLPPLNPTSWWADLRALARNPSFVLSSLGFTAVAFVTGSLALWAPAFLLRSRVVLGETPPCLPGDSCSSSDSLIFGLITCLTGVLGVGLGVEISRRXRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGALSWAPXSSLRPTAGGHSCTCRACCTKQGPQTTGLWCPSGAAPPACPWPVCSSERLPLTYLHICHSXPWAHPTKGLGLTPWPGPASRGTLGRVPAPRHYXGSSGEEVGVQEGDPSPQGXPQGLGAICNGIKFVARPQVPALVFLWVASDLAPRLHPRAPE

SEQ ID NO: 556 - protein, 39 aa, Homo sapiens
MFRFVICLFLWLVLCRDSTSASRIALYYRIVFLIHQCSS

SEQ ID NO: 557 - protein, 58 aa, Homo sapiens
  SITE (5): Xaa equals any of the naturally occurring L-amino acids
MLPWXAQLLDRTIGPLYLLFVQFSPAFSRTSPWRSPKNFRRLYPPCTTSGCAARWLFS

SEQ ID NO: 558 - protein, 152 aa, Homo sapiens
  SITE (7): Xaa equals any of the naturally occurring L-amino acids
  SITE (108): Xaa equals any of the naturally occurring L-amino acids
  SITE (143): Xaa equals any of the naturally occurring L-amino acids
  SITE (152): Xaa equals stop translation
MAGPRPXWRDQLLFMSIIVLVIVVICLMLYALLWEAGNLTDLPNLRIGFYNFCLWNEDTSTLQCHQFPELEALGVPRVGLGLARLGVYGSLVLTLFAPQPLLLAQCNXDERAWRLAVGFLAVSSVLLAGGLGLFLSYVWNGSXSPSRGLGFX

SEQ ID NO: 559 - protein, 33 aa, Homo sapiens
MGLSVLLPLCLLGPGRFTSGQKPLDTPGLGVPF

SEQ ID NO: 560 - protein, 367 aa, Homo sapiens
MAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDYQEKYQELLEREDFFPDYEENGTDLSGAGDPYLDDIDDEMDPEIEEAYEKFCLESERKRKQ

SEQ ID NO: 561 - protein, 77 aa, Homo sapiens
MLRLDIINSLVTTVFMLIVSVLALIPETTTLTVGGGVFALVTAVCCLADGALIYRKLLFNPSGPYQKKPVHEKKEVL

SEQ ID NO: 562 - protein, 47 aa, Homo sapiens
MLKQVMFVFSGMGPRSHCWGLPLACGTFVQGHQADSSHLLPLKHQGA

SEQ ID NO: 563 - protein, 168 aa, Homo sapiens
  SITE (168): Xaa equals stop translation
MLLSLAAFSVISVVSYLILALLSVTISFRIYKSVIQAVQKSEEGHPFKAYLDVDITLSSEAFHNYMNAAMVHINRALKLIIRLFLVEDLVDSLKLAVFMWLMTYVGAVFNGITLLILAELLIFSVPIVYEKYKTQIDHYVGIARDQTKSIVEKIQAKLPGIAKKKAEX

SEQ ID NO: 564 - protein, 124 aa, Homo sapiens
SVPFHLLVVLRSRAVRARRRREPRSLPRPGDEELQLLLCGARSDFLERCEEDWVCLWHHADHAAFPGSFQCHQCGFLPHPGSSLCHHQLQDLQVRHPSCTEVRRRPSIQSLPGRRHYSVLRSFP

SEQ ID NO: 565 - protein, 177 aa, Homo sapiens [sequence omitted]

SEQ ID NO: 566 - protein, 72 aa, Homo sapiens [sequence omitted]

SEQ ID NO: 567 - protein, 45 aa, Homo sapiens
VLRIICLWPCGTTLPLVEKAHDSHSADPVCPGLTAHLPVLLYVQL

SEQ ID NO: 568 - protein, 251 aa, Homo sapiens
  SITE (99): Xaa equals any of the naturally occurring L-amino acids
MKHADPRIQGYPLMGSPLLMTSILLTYVYFVLSLGPRIMANRKPFQLRGFMIVYNFSLVALSLYIVYEFLMSGWLSTYTWRCDPQDCTLGQCPSVPSPXTPVTKAYVVRTEQGTGPPLPTAALQGPRLWFLTHFPRAAPGMWPHCCLPLQSWGLKGLYSYFPLPALKLGRGALRAGPTKGLVAFFLTQKRSAIMSLWTQSHSSTPHTEAVASGPKVRVGGGLGIQPVEAAYSTCVLIKSDRGNHEKKKKKK

SEQ ID NO: 569 - protein, 19 aa, Homo sapiens
GLAGLCGQLSSPALCVNRL

SEQ ID NO: 570 - protein, 217 aa, Homo sapiens
  SITE (20): Xaa equals any of the naturally occurring L-amino acids
  SITE (217): Xaa equals stop translation
MITEKWGLNMEYCRGQAYIXSSGFSSKMKVVASRLLEKYPQAIYTLCSSCALNMWLAKSVPVMGVSVALGTIEEVCSFFHRSPQLLLELDNVISVLFQNSKERGKELKEICHSQWTGRHDAFEILVELLQALVLCLDGINSDTNIRWNNYIAGRAFVLCSAVSDFDFIVTIVVLKNVLSFTRAFGKNLQGQTSDVFFAAGSLTAVLHSLNEVIGKYX

SEQ ID NO: 571 - protein, 82 aa, Homo sapiens
LLKVLCILPVMKVENERYENGRKRLKAYLRNTLTDQRSSNLALLNINFDIKHDLDLMVDTYIKLYTSKSELPTDNSETVENT

SEQ ID NO: 572 - protein, 95 aa, Homo sapiens
MVLILLNLLLGQFSCMSPASHHCHPLPTEMPCSSDWGFDSHTVYPSCVDALLPKPSANSFPNGSCHCQGLYNQQQQNLHAAEGPASLRCNKYVST

SEQ ID NO: 573 - protein, 54 aa, Homo sapiens
  SITE (54): Xaa equals stop translation
MIPAYSKNRAYAIFFIVFTVIGDAPGAVLSCAGHPCVGFAAVLVAPLTVAVSSX

SEQ ID NO: 574 - protein, 108 aa, Homo sapiens
  SITE (108): Xaa equals stop translation
MEVPPPAPRSFLCRALCLFPRVFAAEAVTADSEVLEERQKRLPYVPEPYYPESGWDRLRELFGKDTVNTSLNVYRNKDALSHFVIAGAVTGSLFRINVGLRGWWLVAX

SEQ ID NO: 575 - protein, 50 aa, Homo sapiens
MNWGLSIWLHYYEKKKEQVFLVILAHVVRRCASDGILQFESSLLKMRRAP

SEQ ID NO: 576 - protein, 253 aa, Homo sapiens
  SITE (253): Xaa equals stop translation
MVKVCNDSDRWSLISLSNNSGKNVELKFVDSLRRQFEFSVDSFQIKLDSLLLFYECSENPMTETFHPTIIGESVYGDFQEAFDHLCNKIIATRNPEEIRGGGLLKYCNLLVRGFRPASDEIKTLQRYMCSRFFIDFSDIGEQQRKLESYLQNHFVGLEDRKYEYLMTLHGVVNESTVCLMGHERRQTLNLITMLAIRVLADQNVIPNVANVTCYYQPAPYVADANFSNYYIAQVQPVFTCQQQTYSTWLPCNX

SEQ ID NO: 577 - protein, 18 aa, Homo sapiens
MSFLMWLMSLAITSQPPM

SEQ ID NO: 578 - protein, 80 aa, Homo sapiens
MAPKGKVGTRGKKQIFEENRETLKFYLRIILGANAIYCLVTLVFFYSSASFWAWLALGFSLAVYGASYHSMSSMARAAFF

SEQ ID NO: 579 - protein, 73 aa, Homo sapiens
HLKDVILLTAIVQVLSCFSLYVWSFWLLAPGRALYLLWVNVLGPWFTADSGTPAPEHNEKRQRRQERRQMKRL

SEQ ID NO: 580 - protein, 263 aa, Homo sapiens
  SITE (263): Xaa equals stop translation
MDCPALPPGWKKEEVIRKSGLSAGKSDVYYFSPSGKKFRSKPQLARYLGNTVDLSSFDFRTGKMMPSKLQKNKQRLRNDPLNQNKGKPDLNTTLPIRQTASIFKQPVTKVTNHPSNKVKSDPQRMNEQPRQLFWEKRLQGLSASDVTEQIIKTMELPKGLQGVGPGSNDETLLSAVASALHTSSAPITGQVSAAVEKNPAVWLNTSQPLCKAFIVTDEDIRKQEERVQQVRKKLEEALMADILSRAADTEEMDIEMDSGDEAX

SEQ ID NO: 581 - protein, 70 aa, Homo sapiens
MMRPFYLLLPVLCTQALRQSQGKSPLLWKRTLLFGLTHLNPSAKLLLSQMKTSGNRKSEYSKYARNWKKH

SEQ ID NO: 582 - protein, 34 aa, Homo sapiens
MPVTSKRTLFFPDPCSYDTPPPDCHCHSFRAELL

SEQ ID NO: 583 - protein, 104 aa, Homo sapiens
  SITE (104): Xaa equals stop translation
MNSRGMWLTYALGVGLLHIVLLSIPFFSVPVAWTLTNIIHNLGMYVFLHAVKGTPFETPDQGKSKAPNSLGTTGLWSTVYIFTEVFHNFSNNSIFSGKFLYEVX

SEQ ID NO: 584 - protein, 132 aa, Homo sapiens
MWLTYALGVGLLHIVLLSIPFFSVPVAWTLTNIIHNLGMYVFLHAVKGTPFETPDQGKARLLTHWEQLDYGVQFTSSRKFFTISPIILYFLASFYTKYDPTHFILNTASLLSVLIPKMPQLHGVRIFGINKY

SEQ ID NO: 585 - protein, 32 aa, Homo sapiens
MNKWICEMHCYLVLLSVCSPSALRRVRHTLSR

SEQ ID NO: 586 - protein, 28 aa, Homo sapiens
MPVLSLLCTLIVSFQSADSCEVFLNCSL

SEQ ID NO: 587 - protein, 40 aa, Homo sapiens
MKVSTMLWFLCWEQSHFLREWEDLSTFLILIQMECQYGNS

SEQ ID NO: 588 - protein, 30 aa, Homo sapiens
  SITE (29): Xaa equals any of the naturally occurring L-amino acids
MGLPLMALMWSTLPASAGVNFILALPLLXL

SEQ ID NO: 589 - protein, 29 aa, Homo sapiens
MKRGCLGLLFFSCCSSAPTMLLCDYLNWF

SEQ ID NO: 590 - protein, 92 aa, Homo sapiens
  SITE (76): Xaa equals any of the naturally occurring L-amino acids
  SITE (81): Xaa equals any of the naturally occurring L-amino acids
  SITE (88): Xaa equals any of the naturally occurring L-amino acids
MKLLLGIALLAYVASVWGNFVNMRSIQENGELKIESKIEEMVEPLREKIRDLEKSFTQKYPPVKFLSEKDRKRILXNRRRXVRGLPSXLTNS

SEQ ID NO: 591 - protein, 42 aa, Homo sapiens
MKFSLVLLIKIISFERLLIFLFPLSFLPNIWRRVMVNLNILF

SEQ ID NO: 592 - protein, 70 aa, Homo sapiens
LAQECPPHIPSSFFLVKLLFIPWLASLLPPLSTFTSDFYFMEFGIEVKLQQCRQHQVLQEKNTKKFNKKK

SEQ ID NO: 593 - protein, 110 aa, Homo sapiens
MLRLLLLVAFALVVVLFHVLLAPITALFHTHFYDRLQDAGSRWPELYLYSRADEVVLARDIERMVEARLARRVLARSVDFVSSAHVSHLRDYPTYYTSLCVDFMRNCVRC

SEQ ID NO: 594 - protein, 30 aa, Homo sapiens
MFKLEECGKTTFLLSMALYFWWIVQTTKGC

SEQ ID NO: 595 - protein, 71 aa, Homo sapiens
MESDALLLTIFWIIARSSVRSVGKSSQRSFTTITQLRSTHTGPSRRSYLIWWNGGPKRTISYVSRRFRSFR

SEQ ID NO: 596 - protein, 123 aa, Homo sapiens
  SITE (115): Xaa equals any of the naturally occurring L-amino acids
MFSINPLENLKVYISSRPPLVVFMISVRPMAIAFLTLGYFFKIKEIKSPEMAEDWNTFLLRFNDLDLCVSENETLKHLTNDTTTPESTMTSGQARASTQSPQALEDSGPVNISVXNHPNPGTH

SEQ ID NO: 597 - protein, 47 aa, Homo sapiens
VGLFQPKTFQVPVTDLYIFIKIYSEIGPIMHVLCPGYSQSPSTPPWT

SEQ ID NO: 598 - protein, 39 aa, Homo sapiens
MWFGSDRSDLRIGTAFLFDLVCDLCIHAWKPPGLVRFSF

SEQ ID NO: 599 - protein, 19 aa, Homo sapiens
MLNTASLNLPWKVQLFAHA

SEQ ID NO: 600 - protein, 23 aa, Homo sapiens
MSACLLLFLAFSWKRKGLWSGPG

SEQ ID NO: 601 - protein, 69 aa, Homo sapiens [sequence omitted]

SEQ ID NO: 602 - protein, 77 aa, Homo sapiens
MGPPMLQEISNLFLILLMMGAIFTLAALKESLSTCIPAIVCLGFLLLLNVGQLLAQTKKVVRPTRKKTLSTFKESWK

SEQ ID NO: 603 - protein, 155 aa, Homo sapiens; identical to SEQ ID NO: 466
  SITE (155): Xaa equals stop translation

SEQ ID NO: 604 - protein, 24 aa, Homo sapiens
  SITE (18): Xaa equals any of the naturally occurring L-amino acids
MPETRLGHRQQFAVFHLXPVPPCG

SEQ ID NO: 605 - protein, 38 aa, Homo sapiens
  SITE (30): Xaa equals any of the naturally occurring L-amino acids
MLTFLFSACATCLGKLASPLAPVGPQQRGXPPGPPLLS

SEQ ID NO: 606 - protein, 69 aa, Homo sapiens [sequence omitted]

SEQ ID NO: 607 - protein, 308 aa, Homo sapiens
NLRVRLGDVISIQPCPDVKYGKRIHVLPIDDTVEGITGNLFEVYLKPYFLEAYRPIRKGDIFLVRGGMRAVEFKVVETDPSPYCIVAPDTVIHCEGEPIKREDEEESLNEVGYDDIGGCRKQLAQIKEMVELPLRHPALFKAIGVKPPRGILLYGPPGTGKTLIARAVANETGAFFFLINGPEIMSKLAGESESNLRKAFEEAEKNAPAIIFIDELDAIAPKREKTHGEVERRIVSQLLTLMDGLKQRAHVIVMAATNRPNSIDPALRRFGRFDREVDIGIPDATGRLEILQIHTKNMKLADDVDLEQ

SEQ ID NO: 608 - protein, 22 aa, Homo sapiens
MQIKLLKSVKTVFAITLLVLFL

SEQ ID NO: 609 - protein, 24 aa, Homo sapiens
MFPKFCPILSLVDFISHRDKPETE

SEQ ID NO: 610 - protein, 24 aa, Homo sapiens
MLIECAWQLMFLLLKVEQLGILDK

SEQ ID NO: 611 - protein, 1 aa, Homo sapiens
M

SEQ ID NO: 612 - protein, 8 aa, Homo sapiens
MCIMSALV

SEQ ID NO: 613 - protein, 25 aa, Homo sapiens
MFLVWFFWGLISALSNVHTPSRLPA

SEQ ID NO: 614 - protein, 27 aa, Homo sapiens
  SITE (2): Xaa equals any of the naturally occurring L-amino acids
MXGLSLILTVTLLAVSDSAATCIVAKG

SEQ ID NO: 615 - protein, 61 aa, Homo sapiens
  SITE (16): Xaa equals any of the naturally occurring L-amino acids
MWTRSSRCLLLCIPGXSRRRRAGSGMKPRSWSAWRPSGGTGTSSSQSSTQSRTLSATASPA

SEQ ID NO: 616 - protein, 29 aa, Homo sapiens
MRETSIRVLLMLPALESTSGLSAFMGLGT

SEQ ID NO: 617 - protein, 69 aa, Homo sapiens
MPPKQELGSGVGELAKNSKRQHWNHRWKKYLKLIRWEDGLLLEGLLLVLEHCATMAWDCLMRLELLKRL

SEQ ID NO: 618 - protein, 24 aa, Homo sapiens
KIVYILGNPLKFNSRVIHHLVLLQ

SEQ ID NO: 619 - protein, 35 aa, Homo sapiens
MNLHQRRLLLIGHLMTLVKASKSFSFTEITSSRKK

SEQ ID NO: 620 - protein, 130 aa, Homo sapiens
  SITE (80): Xaa equals any of the naturally occurring L-amino acids
LLGYGLFGHCIVLFITYNIHLHALFYLFWLLVGGLSTLRMVAVLVSRTVGPTQRLLLCGTLAALHMLFLLYLHFAYHKVXEGILDTLEGPNIPPIQRVPRDIPAMLPAARLPTTVLNATAKAVAVTLQSH

SEQ ID NO: 621 - protein, 23 aa, Homo sapiens
MLVIFLFTSLLKIPSSVPGLINV

SEQ ID NO: 622 - protein, 6 aa, Homo sapiens
ELDYIL

SEQ ID NO: 623 - protein, 232 aa, Homo sapiens
  SITE (8): Xaa equals any of the naturally occurring L-amino acids
  SITE (9): Xaa equals any of the naturally occurring L-amino acids
  SITE (10): Xaa equals any of the naturally occurring L-amino acids
  SITE (11): Xaa equals any of the naturally occurring L-amino acids
  SITE (12): Xaa equals any of the naturally occurring L-amino acids
  SITE (232): Xaa equals stop translation
MAPPGWQXXXXXWLACPDRGELSSRSPPCRLARWAEGDRETRTCLLELSAQSWGGRFRRSSAVSAGSPSRLHFLPQPLLLRSSGIPAAATPWPQPAGLPVRPTPTRTGEEDRTLDISICTEVLAGTEQPPPPRMTSPSSSPVFRLETLDGGQEDGSEADRGKLDFGSGLPPMESQFQGEDRKFAPSDKSQPPTTEREQVPVSRIQTDLTEIGSSMRSPGVSPRIWLDFQSTX

SEQ ID NO: 624 - protein, 34 aa, Homo sapiens
  SITE (26): Xaa equals any of the naturally occurring L-amino acids
MVLLLLLAYVLLTYILLLNMLIALMXRDRQQCRH

SEQ ID NO: 625 - protein, 21 aa, Homo sapiens
MVFEGFSSAFCLSSTAPTSHP

SEQ ID NO: 626 - protein, 9 aa, Homo sapiens
GKKNQLLVI

SEQ ID NO: 627 - protein, 29 aa, Homo sapiens
MVWVLWSAPSLAPPWVGPCWPSTGNCCLC

SEQ ID NO: 628 - protein, 30 aa, Homo sapiens
MAKRSPGGCGSGLILLCCQPCRPTSSAPMR

SEQ ID NO: 629 - protein, 113 aa, Homo sapiens
  SITE (13): Xaa equals any of the naturally occurring L-amino acids
  SITE (23): Xaa equals any of the naturally occurring L-amino acids
ITIAIQMICLVNXELYPTFVRNXGVMVCSSLCDIGGIITPFIVFRLREVWQALPLILFAVLGLLAAGVTLLLPETKGVALPETMKDAENLGRKAKPKENTIYLKVQTSEPSGT

SEQ ID NO: 630 - protein, 18 aa, Homo sapiens
TMKDAENLGRKAKPKENT

SEQ ID NO: 631 - protein, 21 aa, Homo sapiens
PRVRNSPEDLGLSLTGDSCKL

SEQ ID NO: 632 - protein, 52 aa, Homo sapiens
QADDLQATVAALCVLRGGGPWAGSWLSPKTPGAMGGDLVLGLGALRRRKRLL

SEQ ID NO: 633 - protein, 232 aa, Homo sapiens
  SITE (15): Xaa equals any of the naturally occurring L-amino acids
  SITE (16): Xaa equals any of the naturally occurring L-amino acids
  SITE (144): Xaa equals any of the naturally occurring L-amino acids
  SITE (148): Xaa equals any of the naturally occurring L-amino acids
EQEKSLAGWALVLAXXGIGLMVLHAEMLWFGGCSAVNATGHLSDTLWLIPITFLTIGYGDVVPGTMWGKIVCLCTGVMGVCCTALLVAVVARKLEFNKAEKHVHNFMMDIQYTKEMKESAARVLQEAWMFYKHTRRKESHAARXHQRXLLAAINAFRQVRLKHRKLREQVNSMVDISKMHMILYDLQQNLSSSHRALEKQIDTLAGKLDALTELLSTALGPRQLPEPSQQSK

SEQ ID NO: 634 - protein, 36 aa, Homo sapiens
YQAHHVSRNKRGQVVGTRGGFRGCTVWLTGLSGAGK

SEQ ID NO: 635 - protein, 174 aa, Homo sapiens [sequence omitted]

SEQ ID NO: 636 - protein, 14 aa, Homo sapiens
VLPWRSTCLPCHPC

SEQ ID NO: 637 - protein, 27 aa, Homo sapiens
FLDGDNVRHGLNRIPQMASWPPKHGRS

SEQ ID NO: 638 - protein, 43 aa, Homo sapiens [sequence omitted]

SEQ ID NO: 639 - protein, 63 aa, Homo sapiens [sequence omitted]

SEQ ID NO: 640 - protein, 28 aa, Homo sapiens
TRPISQLRHYCEPYTTWCQETYSQTKPK

SEQ ID NO: 641 - protein, 45 aa, Homo sapiens [sequence omitted]

SEQ ID NO: 642 - protein, 117 aa, Homo sapiens
  SITE (109): Xaa equals any of the naturally occurring L-amino acids
HSMLPSDVSILYHMKTLLLLQDTERLKHALEMFPEHCTMPPAFIGSCRNQIGRSSVPAAPNVEKYSRSIPKEPTPMTWTQESYNLRGLFPSVHCRAHATHHLACPDPRXATPCDNSR

SEQ ID NO: 643 - protein, 131 aa, Homo sapiens
  SITE (45): Xaa equals any of the naturally occurring L-amino acids
  SITE (46): Xaa equals any of the naturally occurring L-amino acids
  SITE (106): Xaa equals any of the naturally occurring L-amino acids
  SITE (114): Xaa equals any of the naturally occurring L-amino acids
  SITE (117): Xaa equals any of the naturally occurring L-amino acids
LLHELVQAHYPGDVVFTTAASDMETVSEAVRCGVFDYLIKPIAYXXLGQTLTRFRQRKHMLESIDSASQKQIDEMFNAYARGEPKDELPTGIEPLTLNAVRKLFKXPGVQHTAXTVXQALNHQPHHCQALS

SEQ ID NO: 644 - protein, 39 aa, Homo sapiens
TISRTTARRYLEYCASRHLIIAEIVHGKVGRPQRIYHSG

SEQ ID NO: 645 - protein, 65 aa, Homo sapiens
  SITE (62): Xaa equals any of the naturally occurring L-amino acids
MKISFVDLPKSIVVTRPSQNLLSSFTVQPCVLGPQPNSIVPHFTFHGQLPSLLDIKPHILNXVEI

SEQ ID NO: 646 - protein, 10 aa, Homo sapiens
PQFTSAGENF

SEQ ID NO: 647 - protein, 12 aa, Homo sapiens
LKAGKTRTFYGL

SEQ ID NO: 648 - protein, 31 aa, Homo sapiens
AGIDEQENWHEGKENIRAAVAAGCRQIQDLE

SEQ ID NO: 649 - protein, 11 aa, Homo sapiens
SVEVDPCGDAQ

SEQ ID NO: 650 - protein, 22 aa, Homo sapiens
EPPLVFVGKGITFDSGGISIKA

SEQ ID NO: 651 - protein, 26 aa, Homo sapiens
ANMDLMRADMGGAATICSAIVSAAKL

SEQ ID NO: 652 - protein, 23 aa, Homo sapiens
GLAPLCENMPSGKANKPGDVVRA

SEQ ID NO: 653 - protein, 31 aa, Homo sapiens
NGKTIQVDNTDAEGRLILADALCYAHTFNPK

SEQ ID NO: 654 - protein, 44 aa, Homo sapiens
ALGSGATGVFTNSSWLWNKLFEASIETGDRVWRMPLFEHYTRQV

SEQ ID NO: 655 - protein, 69 aa, Homo sapiens
VNNIGKYRSAGACTAAAFLKEFVTHPKWAHLDIAGVMTNKDEVPYLRKGMAAAEGAVLGLYEYDDLKQK

SEQ ID NO: 656 - protein, 16 aa, Homo sapiens
DMTKGLVLGIYSKEKE

SEQ ID NO: 657 - protein, 60 aa, Homo sapiens
MTSELDIFVGNTTLIDEDVYRLWLDGYSVTDAVALRVRSGILEQTGATAAVLQSDTMDHY

SEQ ID NO: 658 - protein, 60 aa, Homo sapiens
RTFHMLERLLHAPPKLLHQLIFQIPPSRQALLIERYYAFDEAFVREVLGKKLSKGTKKDL

SEQ ID NO: 659 - protein, 60 aa, Homo sapiens
DDISTKTGITLKSCRRQFDNFKRVFKVVEEMRGSLVDNIQQHFLLSDRLARDYAAIVFFA

SEQ ID NO: 660 - protein, 33 aa, Homo sapiens
NNRFETGKKKLQYLSFGDFAFCAELMIQNWTLG

SEQ ID NO: 661 - protein, 18 aa, Homo sapiens
AAKLTHNKDVRDLFVDLV

SEQ ID NO: 662 - protein, 28 aa, Homo sapiens
EKFVEPCRSDHWPLSDVRFFLNQYSASV

SEQ ID NO: 663 - protein, 9 aa, Homo sapiens
SLDGFRHQA

SEQ ID NO: 664 - protein, 10 aa, Homo sapiens
RPPTLTIKLL

SEQ ID NO: 665 - protein, 8 aa, Homo sapiens
IMTEVPPN

SEQ ID NO: 666 - protein, 45 aa, Homo sapiens
ISIQRLSNPSMASDTRPSGTATWAPSAAASCACIMTEVPPNVRPR

SEQ ID NO: 667 - protein, 30 aa, Homo sapiens
ERWQHLADLADFALAMKDTLTNINNQSFNN

SEQ ID NO: 668 - protein, 49 aa, Homo sapiens
  SITE (46): Xaa equals any of the naturally occurring L-amino acids
HFLHGPLAQEDKSERERWQHLADLADFALAMKDTLTNINNQSFNNXHCA

SEQ ID NO: 669 - protein, 60 aa, Homo sapiens
MGSRDHLFKVLVVGDAAVGKTSLVQDYSQDSFSKHYKSTVGVDFALKVLQWSDYEIVRLQ

SEQ ID NO: 670 - protein, 60 aa, Homo sapiens
LWDIAGQERFTSMTRLYYRDASACVIMFDVTNATTFSNSQRWKQDLDSKLTLPNGEPVPC

SEQ ID NO: 671 - protein, 60 aa, Homo sapiens
LLLANKCDLSPWAVSRDQIDRFSKENGFTGWTETSVKENKNINEAMRVLIEKMMRNSTED

SEQ ID NO: 672 - protein, 16 aa, Homo sapiens
IMSLSTQGDYINLQTK

SEQ ID NO: 673 - protein, 111 aa, Homo sapiens
RACRHSIYSAWVTSVNITDCKPPSISGAAHQGPTAPGRMVRILANGEIVQDDDPRVRTTTQPPRGSIPRQSFFNRGHGAPPGGPGPRQQQAGARLGAAQSPFNDLNRQLVN

SEQ ID NO: 674 - protein, 57 aa, Homo sapiens
LQCEICGFTCRQKASLNWHMKKHDADSFYQFSCNICGKKFEKKDSVVAHKAKSHPEV

SEQ ID NO: 675 - protein, 19 aa, Homo sapiens
ITSTDILGTNPESLTQPSD

SEQ ID NO: 676 - protein, 19 aa, Homo sapiens
NSTSGECLLLEAEGMSKSY

SEQ ID NO: 677 - protein, 51 aa, Homo sapiens
CSGTERVSLMADGKIFVGSGSSGGTEGLVMNSDILGATTEVLIEDSDSAGP

SEQ ID NO: 678 - protein, 60 aa, Homo sapiens
IQYVRCEMEGCGTVLAHPRYLQHHIKYQHLLKKKYVCPHPSCGRLFRLQKQLLRHAKHHT

SEQ ID NO: 679 - protein, 31 aa, Homo sapiens
DQRDYICEYCARAFKSSHNLAVHRMIHTGEK

SEQ ID NO: 680 - protein, 59 aa, Homo sapiens
SALPQEVSIAASRPSRGWRSSRTSVSRHRDTENTRSSRSKTGSLQLICKSEPNTDQLDY

SEQ ID NO: 681 - protein, 27 aa, Homo sapiens
PFKDDPRDETYKPHLERETPKPRRKSG

SEQ ID NO: 682 - protein, 60 aa, Homo sapiens
QYVRCEMEGCGTVLAHPRYLQHHIKYQHLLKKKYVCPHPSCGRLFRLQKQLLRHAKHHTD

SEQ ID NO: 683 - protein, 32 aa, Homo sapiens
QRDYICEYCARAFKSSHNLAVHRMIHTGEKHY

SEQ ID NO: 684 - protein, 110 aa, Homo sapiens
EMFDSLSYFKGSSLLLMLKTYLSEDVFQHAVVLYLHNHSYASIQSDDLWDSFNEVTNQTLDVKRMMKTWTLQKGFPLVTVQKKGKELFIQQERFFLNMKPEIQPSDTRYM

SEQ ID NO: 685 - protein, 24 aa, Homo sapiens
LEKVASVGNSRPTGQQLESLGLLA

SEQ ID NO: 686 - protein, 18 aa, Homo sapiens
VHREEASCYCQAEPSGDL

SEQ ID NO: 687 - protein, 22 aa, Homo sapiens
RPALRQAGGGTREPRQKRWAGL

SEQ ID NO: 688 - protein, 12 aa, Homo sapiens
AVNFRPQRSQSM

SEQ ID NO: 689 - protein, 11 aa, Homo sapiens
HQPPQPKAPGF

SEQ ID NO: 690 - protein, 67 aa, Homo sapiens
GAQCEVPASPQRPSRPGALPEQTRPLRAPPSSQDKIPQQNSESAMAKPQVVVAPVLMSKLSVNAPEF

SEQ ID NO: 691 - protein, 303 aa, Homo sapiens
EDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDYQEKYQELLEREDFFPDYEENGTDLSGAGDPYL

SEQ ID NO: 692 - protein, 15 aa, Homo sapiens
AYEKFCLESERKRKQ

SEQ ID NO: 693 - protein, 123 aa, Homo sapiens
  SITE (16): Xaa equals any of the naturally occurring L-amino acids
GPGPPPTSALLPRLGXAPKARTKQLSGNLRRSRIYVQLPATTGSKMVCGGFACSKNCLCALNLLYTLVSLLLIGIAAWGIGFGLISSLRVVGVVIAVGIFLFLIALVGLIGAVKHHQVLLFFY

SEQ ID NO: 694 - protein, 37 aa, Homo sapiens
MITDVQLAIFANMLGVSLFLLVVLYHYVAVNNPKKQE

SEQ ID NO: 695 - protein, 342 aa, Homo sapiens
EEMADSVKTFLQDLARGIKDSIWGICTISKLDARIQQKREEQRRRRASSVLAQRRAQSIERKQESEPRIVSRIFQCCAWNGGVFWFSLLLFYRVFIPVLQSVTARIIGDPSLHGDVWSWLEFFLTSIFSALWVLPLFVLSKVVNAIWFQDIADLAFEVSGRKPHPFPSVSKIIADMLFNLLLQALFLIQGMFVSLFPIHLVGQLVSLLHMSLLYSLYCFEYRWFNKGIEMHQRLSNIERNWPYYFGFGLPLAFLTAMQSSYIISGCLFSILFPLFIISANEAKTPGKAYLFQLRLFSLVVFLSNRLFHKTVYLQSALSSSTSAEKFPSPHPSPAKLKATAGH

SEQ ID NO: 696 - protein, 365 aa, Homo sapiens
MATPASAPDTRALVADFVGYKLRQKGYVCGAGPGEGPAADPLHQAMRAAGDEFETRFRRTFSDLAAQLHVTPGSAQQRFTQVSDELFQGGPNWGRLVAFFVFGAALCAESVNKEMEPLVGQVQEWMVAYLETRLADWIHSSGGWLSQITEAEMADEVICSEILSDCDSAASSPDLEELEAIKARVREMEEEAEKLKELQNEVEKQMNMSPPPGNAGPVIMSIEEKMEADARSIYVGNVDYGATAEELEAHFHGCGSVNRVTILCDKFSGHPKGFAYIEFSDKESVRTSLALDESLFRGRQIKVIPKRTNRPGISTTDRGFPRARYRARTTNYNSSRSRFYSGFNSRPRGRVYRGRARATSWYSPY

SEQ ID NO: 697 - protein, 25 aa, Homo sapiens
VEKQMNMSPPPGNAGPVIMSIEEKM

SEQ ID NO: 698 - protein, 11 aa, Homo sapiens
ELEAIKARVRC

SEQ ID NO: 699 - protein, 34 aa, Homo sapiens
VDYGATAEELEAHFHGCGSVNRVTILCDKFSGHP

SEQ ID NO: 700 - protein, 30 aa, Homo sapiens
ALDESLFRGRQIKVIPKRTNRPGISTTDRG

SEQ ID NO: 701 - protein, 278 aa, Homo sapiens
PRRVEPLYIEVDQIYHLASPASPPNYMYNPIKTLKTNTIGTLNMLGLAKRVGARLLLASTSEVYGDPEVHPQSEDYWGHVNPIGPRACYDEGKRVAETMCYAYMKQEGVEVRVARIFNTFGPRMHMNDGRVVSNFILQALQGEPLTVYGSGSQTRAFQYVSDLVNGLVALMNSNVSSPVNLGNPEEHTILEFAQLIKNLVGSGSEIQFLSEAQDDPQKRKPDIKKAKLMLGWEPVVPLEEGLNKAIHYFRKELEYQANNQYIPKPKPARIKKGRTRHS

SEQ ID NO: 702 - protein, 11 aa, Homo sapiens
MLGLAKRVGAR

SEQ ID NO: 703 - protein, 12 aa, Homo sapiens
LLASTSEVYGDP

SEQ ID NO: 704 - protein, 16 aa, Homo sapiens
IGPRACYDEGKRVAET

SEQ ID NO: 705 - protein, 8 aa, Homo sapiens
RVARIFNT

SEQ ID NO: 706 - protein, 10 aa, Homo sapiens
NDGRVVSNFI

SEQ ID NO: 707 - protein, 430 aa, Homo sapiens
  SITE (68): Xaa equals any of the naturally occurring L-amino acids
  SITE (181): Xaa equals any of the naturally occurring L-amino acids
  SITE (187): Xaa equals any of the naturally occurring L-amino acids
YQAARIYYIMAEEVEWDYCPDRSWEREWHNQSEKDSYGYIFLSNKDGLLGSRYKKAVFREYTDGTFRXPRPRTGPEEHLGILGPLIKGEVGDILTVVFKNNASRPYSVHAHGVLESTTVWPLAAEPGEVVTYQWNIPERSGPGPMTLLVFPGSIILQWIPSRTCIVAWWGPWLSAKRASWXPHGGRXDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLASVLVAISVTLLLVVLALGGVVWYQHRQRKLRRNRRSILDDSFKLLSFKQ

SEQ ID NO: 708 - protein, 58 aa, Homo sapiens
  SITE (53): Xaa equals any of the naturally occurring L-amino acids
GGHLSVEHPREVWPWANDSACVSWIYYSAVDPIKDMYSGLVGPLAICQKGILXAPWRT

SEQ ID NO: 709 - protein, 38 aa, Homo sapiens
ARGGPRQPSRFAVRSPGVRPTPSRGLRSLQSQTLSDLD

SEQ ID NO: 710 - protein, 14 aa, Homo sapiens
GFSSVLQFLGLYKK

SEQ ID NO: 711 - protein, 35 aa, Homo sapiens
GKLVFLGLDNAGKTTLLHMLKDDRLGQHVPTLHPT

SEQ ID NO: 712 - protein, 19 aa, Homo sapiens
SEELTIAGMTFTTFDLGGH

SEQ ID NO: 713 - protein, 25 aa, Homo sapiens
QARRVWKNYLPAINGIVFLVDCADH

SEQ ID NO: 714 - protein, 13 aa, Homo sapiens
NVPILILGNKIDR

SEQ ID NO: 715 - protein, 19 aa, Homo sapiens
EVFMCSVLKRQGYGEGFRW

SEQ ID NO: 716 - protein, 80 aa, Homo sapiens
  SITE (37): Xaa equals any of the naturally occurring L-amino acids
  SITE (69): Xaa equals any of the naturally occurring L-amino acids
STHASELRRRREPVGVWSSRRPRGPDAAPGAGRRWCXAASGPPRAATSEPSATAGVRRAAGPAGPGARXARRGGVELIRI

SEQ ID NO: 717 - protein, 218 aa, Homo sapiens
ECLDCHLHCCLLDQVVPKHYTLDASLPLRLRPESMEKLRCLRACVIRSLYHMYEPFAARISKNPAIPESTPSTLKNSKCLLFWCRKIVGNRQEPMWEFNFKFKKQSPRLKSKCTGGLQPPVQYEDVHTNPDQDCCLLQVTTLNFIFIPIVMGMIFTLFTINVSTDMRHHRVRLVFQDSPVHGGRKLRSEQGVQVILDPVHSVRLFDWWHPQYPFSLRA

SEQ ID NO: 718 - protein, 10 aa, Homo sapiens
LMRSIGNKNT

SEQ ID NO: 719 - protein, 10 aa, Homo sapiens
AWYGFGSEPC

SEQ ID NO: 720 - protein, 17 aa, Homo sapiens
SSITFPAVSALVSRTAD

SEQ ID NO: 721 - protein, 60 aa, Homo sapiens
ADQQGVVQGMITGIRGLCNGLGPALYGFIFYIFHVELKELPITGTDLGTNTSPQHHFEQN

SEQ ID NO: 722 - protein, 14 aa, Homo sapiens
SIIPGPPFLFGACS

SEQ ID NO: 723 - protein, 37 aa, Homo sapiens
FIPEHTNLSLRSSSWRKHCGSHSHPHNTQAPGEAKEP

SEQ ID NO: 724 - protein, 7 aa, Homo sapiens
LLQDTNV

SEQ ID NO: 725 - protein, 42 aa, Homo sapiens
SKGNSSHSKELEASPSVVGRQPGAVFWELWDVPLGARENRRK

SEQ ID NO: 726 - protein, 20 aa, Homo sapiens
VEPISLGLALAGVLTGYIYP

SEQ ID NO: 727 - protein, 27 aa, Homo sapiens
PLTLSLHGWTGTGKNFVSKIIAENIYE

SEQ ID NO: 728 - protein, 24 aa, Homo sapiens
NITLYKDQLQLWIRGNVSACARSI

SEQ ID NO: 729 - protein, 27 aa, Homo sapiens
DFWRSGKQREDIKLKDIEHALSVSVFN

SEQ ID NO: 730 - protein, 22 aa, Homo sapiens
LIDYFVPFLPLEYKHLKMCIRV

SEQ ID NO: 731 - protein, 18 aa, Homo sapiens
VSRVAEEMTFFPKEERVF

SEQ ID NO: 732 - protein, 529 aa, Homo sapiens
  SITE (219): Xaa equals any of the naturally occurring L-amino acids
  SITE (220): Xaa equals any of the naturally occurring L-amino acids
MAKFMTPVIQDNPSGWGPCAVPEQFRDMPYQPFSKGDRLGKVADWTGATYQDKRYTNKYSSQFGGGSQYAYFHEEDESSFQLVDTARTQKTAYQRNRMRFAQRNLRRDKDRRNMLQFNLQILPKSAKQKERERIRLQKKFQKQFGVRQKWDQKSQKPRDSSVEVRSDWEVKEEMDFPQLMKMRYLEVSEPQDIECCGALEYYDKAFDRITTRSEKPLRXXKRIFHTVTTTDDPVIRKLAKTQGNVFATDAILATLMSCTRSVYSWDIVVQRVGSKLFFDKRDNSDFDLLTVSETANEPPQDEGNSFNSPRNLAMEATYINHNFSQQCLRMGKERYNFPNPNPFVEDDMDKNEIASVAYRYRSGKLGDDIDLIVRCEHDGVMTGANGEVSFINIKTLNEWDSRHCNGVDWRQKLDSQRGAVIATELKNNSYKLARWTCCALLAGSEYLKLGYVSRYHVKDSSRHVILGTQQFKPNEFASQINLSVENAWGILRCVIDICMKLEEGKYLILKDPNKQVIRVYSLPDGTFSS

SEQ ID NO: 733 - protein, 98 aa, Homo sapiens
CQSHLSRLGASEANEDAWRNAVTDFRVDLRFTAREFFRPTQRKRESSLRQRRSCLRRRPLRAHVSSFPGFSRVLLLTRSPARTICCHPGRPRHCRFWK

SEQ ID NO: 734 - protein, 132 aa, Homo sapiens
  SITE (26): Xaa equals any of the naturally occurring L-amino acids
KLKSFQTRDNQGILYEAAPTSTLTCXSGPQKQKFSLKLDAKDGRLFNEQNFFQRAAKPLQVNKWKKLYSTPLLAIPTCMGFGVHQDKYRFLVLPSLGRSLQSALDVSPKHVLCREVCAAGGLPAAGCPGVPP

SEQ ID NO: 735 - protein, 194 aa, Homo sapiens
  SITE (115): Xaa equals any of the naturally occurring L-amino acids
KKRHTDVQFYTEVGEITTDLGKHQHMHDRDDLYAEQMEREMRHKLKTAFKNFIEKVEALTKEELEFEVPFRDLGFNGAPYRSTCLLQPTSSALVNATEWPPFVVTLDEVELIHFXRVQFHLKNFDMVIVYKDYSKKVTMINAIPVASLDPIKEWLNSCDLKYTEGVQSLNWTKIMKTIVDDPEGFFEQGGWSFL

SEQ ID NO: 736 - protein, 36 aa, Homo sapiens
MASGADSKGDDLSTAILKQKNRPNRLIVDEAINEDN

SEQ ID NO: 737 - protein, 24 aa, Homo sapiens
GKKRREAVCIVLSDDTCSDEKIRM

SEQ ID NO: 738 - protein, 24 aa, Homo sapiens
GDVISIQPCPDVKYGKRIHVLPID

SEQ ID NO: 739 - protein, 35 aa, Homo sapiens
ITGNLFEVYLKPYFLEAYRPIRKGDIFLVRGGMRA

SEQ ID NO: 740 - protein, 32 aa, Homo sapiens
GYDDIGGCRKQLAQIKEMVELPLRHPALFKAI

SEQ ID NO: 741 - protein, 37 aa, Homo sapiens
PPGTGKTLIARAVANETGAFFFLINGPEIMSKLAGES

SEQ ID NO: 742 - protein, 35 aa, Homo sapiens
RRIVSQLLTLMDGLKQRAHVIVMAATNRPNSIDPA

SEQ ID NO: 743 - protein, 29 aa, Homo sapiens
VDIGIPDATGRLEILQIHTKNMKLADDVD

SEQ ID NO: 744 - protein, 21 aa, Homo sapiens
EAALQAIRKKMDLIDLEDETI

SEQ ID NO: 745 - protein, 35 aa, Homo sapiens
TVVEVPQVTWEDIGGLEDVKRELQELVQYPVEHPD

SEQ ID NO: 746 - protein, 35 aa, Homo sapiens
NECQANFISIKGPELLTMWFGESEANVREIFDKAR

SEQ ID NO: 747 - protein, 30 aa, Homo sapiens
ILTEMDGMSTKKNVFIIGATNRPDIIDPAI

SEQ ID NO: 748 - protein, 33 aa, Homo sapiens
IYIPLPDEKSRVAILKANLRKSPVAKDVDLEFL

SEQ ID NO: 749 - protein, 27 aa, Homo sapiens
DPVPEIRRDHFEEAMRFARRSVSDNDI

SEQ ID NO: 750 - protein, 15 aa, Homo sapiens
QTLQQSRGFGSFRFP

SEQ ID NO: 751 - protein, 413 aa, Homo sapiens
CGPGTVANETHGHVGADLAALCSEAALQAIRKKMDLIDLEDETIDAEVMNSLAVTMDDFRWALSQSNPSALRETVVEVPQVTWEDIGGLEDVKRELQELVQYPVEHPDKFLKFGMTPSKGVLFYGPPGCGKTLLAKAIANECQANFISIKGPELLTMWFGESEANVREIFDKARQAAPCVLFFDELDSIAKARGGNIGDGGGAADRVINQILTEMDGMSTKKNVFIIGATNRPDIIDPAILRPGRLDQLIYIPLPDEKSRVAILKANLRKSPVAKDVDLEFLAKMTNGFSGADLTEICQRACKLAIRESIESEIRRERERQTNPSAMEVEEDDPVPEIRRDHFEEAMRFARRSVSDNDIRKYEMFAQTLQQSRGFGSFRFPSGNQGGAGPSQGSGGGTGGSVYTEDNDDDLYG

SEQ ID NO: 752 - protein, 70 aa, Homo sapiens
RSGLGLGITIAFLATLITQFLVYNGVYQYTSPDFLYIRSWLPCIFFSGGVTVGNIGRQLAMGVPEKPHSD

SEQ ID NO: 753 - protein, 62 aa, Homo sapiens
ETRVKTSLELLRTQLEPTGTVGNTINFSQAEKPEPTNQGQDSLKKHLHAEIKVIGTIQILCG

SEQ ID NO: 754 - protein, 101 aa, Homo sapiens
  SITE (29): Xaa equals any of the naturally occurring L-amino acids
  SITE (30): Xaa equals any of the naturally occurring L-amino acids
  SITE (32): Xaa equals any of the naturally occurring L-amino acids
VTQPKHLSASMGGSVEIPFSFYYPWELAXXPXVRISWRRGHFHGQSFYSTRPPSIHKDYVNRLFLNWTEGQESGFLRISNLRKEDQSVYFCRVELDTRRSG

SEQ ID NO: 755 - protein, 357 aa, Homo sapiens
  SITE (68): Xaa equals any of the naturally occurring L-amino acids
MATPAVPVSAPPATPTPVPAAAPASVPAPTPAPAAAPVPAAAPACILRPCGSSGCNCGSWPDPGLSAXPAQTPAPALPGPALPGPFPGGRVVRLHPVILASIVDSYERRNEGAARVIGTLLGTVDKHSVEVTNCFSVPHNESEDEVAVDMEFAKNMYELHKKVSPNELILGWYATGHDITEHSVLIHEYYSREAPNPIHLTVDTSLQNGRMSIKAYVSTLMGVPGRTMGVMFTPLTVKYAYYDTERIGVDLIMKTCFSPNRVIGLSSDLQQVGGASARIQDALSTVLQYAEDVLSGKVSADNTVGRFLMSLVNQVPKIVPDDFETMLNSNINDLLMVTYLANLTQSQIALNEKLVNL

SEQ ID NO: 756 - protein, 32 aa, Homo sapiens; identical to SEQ ID NO: 489

SEQ ID NO: 757 - protein, 233 aa, Homo sapiens
  SITE (18): Xaa equals any of the naturally occurring L-amino acids
MEAQQVNEAESAREQLQXLHDQIAGQKASKQELETELERLKQEFHYIEEDLYRTKNTLQSRIKDRDEEIQKLRNQLTNKTLSNSSQSELENRLHQLTETLIQKQTMLESLSTEKNSLVFQLERLEQQMNSASGSSSNGSSINMSGIDNGEGTRLRNVPVLFNDTETNLAGMYGKVRKAASSIDQFSIRLGIFLRRYPIARVFVIIYMALLHLWVMIVLLTYTPEMHHDQPYGK

What is claimed is:

1. An isolated protein comprising amino acid residues 27 to 234 of SEQ ID NO:478.

2. The isolated protein of claim 1 which comprises amino acid residues 2 to 234 of SEQ ID NO:478.

3. The isolated protein of claim 1 which comprises amino acid residues 1 to 234 of SEQ ID NO:478.

4. The protein of claim 1 which comprises a heterologous polypeptide sequence.

5. A composition comprising the protein of claim 1 and a pharmaceutically acceptable carrier.

6. An isolated protein produced by the method comprising:
(a) expressing the protein of claim 1 by a cell; and
(b) recovering said protein.

7. An isolated protein comprising the amino acid sequence of the secreted portion of the polypeptide encoded by the HNFIP24 cDNA contained in ATCC Deposit No. 97903.

8. The isolated protein of claim 7 which comprises the amino acid sequence of the complete polypeptide encoded by the HNFIP24 cDNA contained in ATCC Deposit No. 97903, excepting the N-terminal methionine.

9. The isolated protein of claim 7 which comprises the amino acid sequence of the complete polypeptide encoded by the HNFIP24 cDNA contained in ATCC Deposit No. 97903.

10. The protein of claim 7 which comprises a heterologous polypeptide sequence.

11. A composition comprising the protein of claim 7 and a pharmaceutically acceptable carrier.

12. An isolated protein produced by the method comprising:
(a) expressing the protein of claim 7 by a cell; and
(b) recovering said protein.

13. An isolated protein comprising a polypeptide sequence which is at least 90% identical to amino acid residues 27 to 234 of SEQ ID NO:478.

14. The isolated protein of claim 13 wherein said polypeptide sequence is at least 90% identical to amino acid residues 1 to 234 of SEQ ID NO:478.

15. The isolated protein of claim 13 wherein said polypeptide sequence is at least 95% identical to amino acid residues 27 to 234 of SEQ ID NO:478.

16. The isolated protein of claim 13 wherein said polypeptide sequence is at least 95% identical to amino acid residues 1 to 234 of SEQ ID NO:478.

17. The protein of claim 13 which comprises a heterologous polypeptide sequence.

18. A composition comprising the protein of claim 13 and a pharmaceutically acceptable carrier.

19. An isolated protein produced by the method comprising:
(a) expressing the protein of claim 13 by a cell; and
(b) recovering said protein.

20. An isolated protein comprising a polypeptide sequence which is at least 90% identical to the secreted portion of the polypeptide encoded by the HNFIP24 cDNA contained in ATCC Deposit No. 97903.

21. The isolated protein of claim 20 wherein saod polypeptide sequence is at least 95% identical to the secreted portion of the polypeptide encoded by the HNFIP24 cDNA contained in ATCC Deposit No. 97903.

22. The protein of claim 20 which comprises a heterologous polypeptide sequence.

23. A composition comprising the protein of claim 20 and a pharmaceutically acceptable carrier.

24. An isolated protein produced by the method comprising:
(a) expressing the protein of claim 20 by a cell; and
(b) recovering said protein.

25. An isolated protein comprising at least 30 contiguous amino acid residues of amino acid residues 27 to 234 of SEQ ID NO:478.

26. The isolated protein of claim 25 which comprises at least 50 contiguous amino acid residues of amino acid residues 27 to 234 of SEQ ID NO:478.

27. The protein of claim 25 which comprises a heterologous polypeptide sequence.

28. A composition comprising the protein of claim 25 and a pharmaceutically acceptable carrier.

29. An isolated protein produced by the method comprising:
(a) expressing the protein of claim 25 by a cell; and
(b) recovering said protein.

30. An isolated protein comprising at least 30 contiguous amino acid residues of the secreted portion of the polypeptide encoded by the HNFIP24 cDNA contained in ATCC Deposit No. 97903.

31. The isolated protein of claim 30 which comprises at least 50 contiguous amino acid residues of the secreted portion of the polypeptide encoded by the HNFIP24 cDNA contained in ATCC Deposit No. 97903.

32. The protein of claim 30 which comprises a heterologous polypeptide sequence.

33. A composition comprising the protein of claim 30 and pharmaceutically acceptable carrier.

34. An isolated protein produced by the method comprising:
(a) expressing the protein of claim 30 by a cell; and
(b) recovering said protein.

35. An isolated protein comprising at least 30 contiguous amino acid residues of amino acid residues 1 to 234 of SEQ ID NO:478.

36. The isolated protein of claim 35 which comprises at least 50 contiguous amino acid residues of amino acid residues 1 to 234 of SEQ ID NO:478.

37. The protein of claim 35 which comprises a heterologous polypeptide sequence.

38. A composition comprising the protein of claim 35 and a pharmaceutically acceptable carrier.

39. An isolated protein produced by the method comprising:

(a) expressing the protein of claim 35 by a cell; and (b) recovering said protein.

40. An isolated protein comprising at least 30 contiguous amino acid residues of the complete polypeptide encoded by the HNFIP24 cDNA contained in ATCC Deposit No. 97903.

41. The isolated protein of claim 40 which comprises at least 50 contiguous amino acid residues of the complete polypeptide encoded by the HNFIP24 cDNA contained in ATCC Deposit No. 97903.

42. The protein of claim 40 which comprises a heterologous polypeptide sequence.

43. A composition comprising the protein of claim 40 and pharmaceutically acceptable carrier.

44. An isolated protein produced by the method comprising:

(a) expressing the protein of claim 40 by a cell; and (b) recovering said protein.

45. An isolated protein comprising a polypeptide sequence which is at least 90% identical to the complete polypeptide encoded by the HNFIP24 cDNA contained in ATCC Deposit No. 97903.

46. The isolated protein of claim 45, wherein said polypeptide sequence is at least 95% identical to the complete polypeptide encoded by the HNFIP24 cDNA contained in ATCC Deposit No. 97903.

47. The protein of claim 45 which comprises a heterologous polypeptide sequence.

48. The protein of claim 47, wherein said heterologous polypeptide sequence is the Fc domain of immunoglobulin.

49. A composition comprising the protein of claim 45 and a pharmaceutically acceptable carrier.

50. An isolated protein produced by a method comprising:

(a) expressing the protein of claim 45 by a cell; and (b) recovering said protein.

51. The protein of claim 4, wherein said heterologous polypeptide sequence is the Fc domain of immunoglobulin.

52. The protein of claim 10, wherein said heterologous polypeptide sequence is the Fc domain of immunoglobulin.

53. The protein of claim 17, wherein said heterologous polypeptide sequence is the Fc domain of immunoglobulin.

54. The protein of claim 22, wherein said heterologous polypeptide sequence is the Fc domain of immunoglobulin.

55. The protein of claim 27, wherein said heterologous polypeptide sequence is the Fc domain of immunoglobulin.

56. The protein of claim 32, wherein said heterologous polypeptide sequence is the Fc domain of immunoglobulin.

57. The protein of claim 37, wherein said heterologous polypeptide sequence is the Fc domain of immunoglobulin.

58. The protein of claim 42, wherein said heterologous polypeptide sequence is the Fc domain of immunoglobulin.

* * * * *